United States Patent 11,098,302 (IDENTIFICATION OF POLYNUCLEOTIDES ASSOCIATED WITH A SAMPLE) - sequence listing, part 30

SEQ ID NO: 100621 - DNA, 603 bp, Homo sapiens
  misc_feature: GYAE6OF01ALED7.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccagggaaanagccaccctctcttgcagggccagtcaagacattaggaactacttagcctggtacccaacagaacgcctggccaggcctcccaggctgctcatctatgatgcatccagcgagggccactggcactccccagccctaggttcaggtcggcaggtgggtctggggacaggtacttccacttcctccacccactcccgcacgcctaagcgcctaggaacgtactttggtacggttttaatacctgtaccaaactaccgtaacccaacgtcggtcccttaccgttccgttacggtacccgttaccgggaccgaaacgggtaccgtaagggtacggaaactaccgaaacgaacgtggtcggtactaggaccacctagtcctgttaccttctactcccttcccgctac

SEQ ID NO: 100622 - DNA, 671 bp, Homo sapiens
  misc_feature: GYAE6OF01BZZC9.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggaactacttagcctggtaccaacagaagcctggccaggctcccgaggctgctcatctatgatgcatccagcagggccacgtggtactcccagccgaggttcagtggctaggtggggtcgtgggacaggacttcacttcctccaaccacttccccggacacggccctaaggacgtcccgtaggaaacgttcttttacggtccggtttttaattaccgttgtaaccaaaccgtaaaccgttacccgtaaacttcgggtaccccttcccggttacgttccgggtaccggtttccgggacccgtaaaagggggacccgtaaggggtacggtaaaactaccgtaaaaacggtaccgttagggtcggaccgtcgaccgtaacctacgttccttaggttccctttactactttccccgtttccccgcctacgttacccg

SEQ ID NO: 100623 - DNA, 706 bp, Homo sapiens
  misc_feature: GYAE6OF01EPO2B.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagacattaggaactacttagcctggtaccaacagaagcctggccaggcctcccgaggctgctcatctatgatgcatccagcgaggccacgtggcactcccagcccgtaggttcaggtcggacgtaggtgggtctggggacctaggtacctttcgaccttccgtacaacccgtacgtacccggctaacggtacccgttaagggaccgtaccgtttacgggaaacggttaccgtttttgggtaccgggttttttaataaccggttcgtttaacccaaacgttaacccgttaacccgaacgttcccgggtaccctttcccggttacgtttacggggtacccggtttacccggggacccgtaaacggggtaccctaaggggttacgtaaaactaccgtaaaaccggtacgtacggtacgggtactacggaccacccgtagttaccgtcgttccttacctacttccccttccccgccttacg

SEQ ID NO: 100624 - DNA, 728 bp, Homo sapiens
  misc_feature: GYAE6OF01DBJUD.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccgaaggggaaagacgcccaccctctcttgcgacgggccagtcaagactagttaaggaactacttacgcctaggtaaccaacagaacgctaggccgaggcctcccgaggctcgctcatctatgatgacatccagccgacgggccacgtggcctactaccccgaggacccgtaggttcgaaggtcggacgtagggttcggggtccgtaggggaacctaggtacctttaccgacctttctaccaaccgtacgtcccggactaacgtaccgtaacgacgtccgtaacggtaacgttaccgttttacggtacggttttaacttacgtacgttaacctaaaaccgtaaccgttaaccctaaaccgttcggtacccgtttacccggttacgtttacgggtaacccggtttaccgggaccggtaaacggggaacgtaaacgggtaggtaaaacgtaaccgaaaacggtacgttggtacggtctaccggactaccgtacgttccgttacgtttaccttactacgtttacccctccgtacctaacg

SEQ ID NO: 100625 - DNA, 295 bp, Homo sapiens
  misc_feature: GYAE6OF01BD7GR.23.37.D04.1.454.CMB.1.raw
  modified_base (292)..(295): a, c, t, g, unknown or other
  misc_feature (292)..(295): n is a, c, g, or t
tcagacgcgagtatcacgaccggtgctcgatttagtagcatactgttgggtttgggggtgaccgctgcggacacggccgtgtactactgtgcgagagatagggctgcgggaggtttcgacgtctggggccaggggaccacggtcaccgtctcctcagcttccaccaagggcccatccgtcttccccctggcgccctgctccaggagcacctccgagagcacagccgccctgggctgcctggtcaaggactacttccatactcgcgtctgagcgggctggcaaggcgcatagnnnn

SEQ ID NO: 100626 - DNA, 642 bp, Homo sapiens
  misc_feature: GYAE6OF01CNNQO.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccaaggggaaagagcccaccctctcttgcagggccagtcaagacattaggaactactagcctggtaccaacagaagctggccaggcctccaggctgctcatctatgatgacatccagcagggcccagtggccactcccgagaccaggttcaggtcggcgtaggtgggtctaggggacaggtacctttcaccgtcctccacccagtccccgctaacgcctaggacgtccgtaggaaacgttcgtttaggtacggttttaatacgtacgtaccaaaccgtaacgttacccaacgtcgtcccttcggttccttgggacccgttacgggaccgaaagggtacctaagggtacgaaaataccgaaacgtacgttgggacggtacctacggacctaacccgtagtccgtttacggttcctttaccaccgtttaccccttccccggtacttaaccg

SEQ ID NO: 100627 - DNA, 222 bp, Homo sapiens
  misc_feature: GYAE6OF01ESDMY.23.37.D04.1.454.CMB.1.raw
  modified_base (213)..(213): a, c, t, g, unknown or other
  misc_feature (213)..(213): n is a, c, g, or t
  modified_base (219)..(222): a, c, t, g, unknown or other
  misc_feature (219)..(222): n is a, c, g, or t
tcagacgcgagtatcacgaccggtgctcgatttagtagcatactgttgggtttggggggaagaggaagactgacggtcctcccaggagttcaggtgctgggcaccttgggcacgggggaggtgtgtcacaagatttgggctctgggcacagcggccctggctgcctggtcaaggactacttccatactcgcgtctgagcgggctggcaaggcncatagnnnn

SEQ ID NO: 100628 - DNA, 682 bp, Homo sapiens
  misc_feature: GYAE6OF01D7FON.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaagagccaccctctcttgcagggccagtcaagacattaggaactacttagcctggtaccaacagaagcctggccaggctcccaggctgctcatctatgatgcatccagcgacgggccacgtggcactcccagccaggttcaggtggctaggtgggtctggggacagtaccttcactctcaccatcccgcacgcctagacgcctaggaacgtacgtttcggtacggttttaacttacgttacgtaacctaaaccgtaaccgtaaccctaacgtccggtcccttacccggttacgtttacgggtaacccggtttaccgggacccggtaaacggggtaacccgtaaaggggttaacggtaaaacgtaacccgtaaaaaccggtaccgttacggggttacgggaccgttacgtacccgtaacccttaagttcccgttacggtttccctttaccgtaccgttttccccttccccggtaccttaaccgg

SEQ ID NO: 100629 - DNA, 615 bp, Homo sapiens
  misc_feature: GYAE6OF01BS0PM.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagacattaggaactacttagcctggtaccaacagaagcctggccaggcctcccaggctgctcatctatgatgcatccgagcagggccacgtggccatcccgagcccaggttcaggtcgcgtaggtcgggtctagggacagtacttcactctcaccactccgcacgcctagacgtcctaggtaacgtacgtttcggtacggttttaactacgttacgtaccaaaaccgtaaccgtaccctaacgttcggtacccttaccggtacgtttacgggtaccggttaccggacccgtaaagggtaccctaaagggtacgaaacgtaccgaaacgtacgtgtacggtacacgctacgtactcgtcgttacttacacttcccgttccgctaacg

SEQ ID NO: 100630 - DNA, 815 bp, Homo sapiens
  misc_feature: GYAE6OF01EN100.23.37.D04.1.454.CMB.1.raw
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
tcagacgcgagtatcacgaccggtgctcgatttagtagcatactgttgggtttgggggaggaactgctcagttaggacccagagggaaccatggaacgccccagctcagcttctcttcctcctgctactctggcctcccagagaccaccggaagaaattgtgttgacacagtctccagcccacctgttctttcgtaccccgaaggggaancgcccaccctctctgcgaggccagtcaagacattaggaactactagctaggtaccaanagaacgcctggccaggcctcccgaggctgctacatctatgatgacactccgacgcggacgggccctacgtcggaccacgtcccgagtccgtaaggttcaggtcggacgtagggttcgggtccgtagggaacgtacggtaccttacgacccgttctaccgaaacccgtacgttccccggaacgtaccggtaccctaagggaaccgttcccgtaaagggttaaacgttaccggttttttcggtaaccgggttttttaaattaccgttaccgttaaaccgtaaaacccgttaaaccccggttaaccctaaccgggttcccgggtcccctttaccgggtttaccggtttaacggggtaaccccgggtttacccgggaaaccgggtaaaaccgggggtaaccggttaaacggggtaaacggttaaaaccgtaaccggaaaaaccgggttaaccgttgggtaaccgggtccttaacgaccccggttaaaccctgtttacccgttccggttacctttaaccgtacccttttcccccttcccggacctttaaacg

SEQ ID NO: 100631 - DNA, 632 bp, Homo sapiens
  misc_feature: GYAE6OF01CE0I3.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaagngccaccctctcttgcagggccagtcaagacattaggaactacttagcctggtaccaacagaagcctggccaggctcccaggcctgctcatctatgatcgcatccaggcgacgggccacgtcggcactcccaggtcccaggttcaggtcggctagggtcgggctaggggactacggactttcgaaccttcctacaaccctacgtcccgacaacggtccctaaggacgtcccgtaggtaaaccgtacgttttgggaccgttttaatacttcgtaaccaaacgtaaccgtaccctaacgtcggtaccttccggtcgttacgggtaccggttacggaccgtaacgggacaacggtaggaaactacgaaacgtactggtacgtcgtagacctactacgttcttacgttcttacctacgtcccttcccgctaacg

SEQ ID NO: 100632 - DNA, 539 bp, Homo sapiens
  misc_feature: GYAE6OF01EC1CE.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcatcccagccaggttcaggtggcaggtgggtctgggacagtacttcactctcaccatccgcagcctagacgcctagaagtactttgcggtttatactgtacaacgtaacgtaccaacgtcggcctcgtcgttggaccgttcggaccgaagggaccaaggtacggaaatacgaaacgactggtaggctgacaccagtctgttctcatccttcccgctac

SEQ ID NO: 100633 - DNA, 635 bp, Homo sapiens
  misc_feature: GYAE6OF01EDUQW.23.37.D04.1.454.CMB.1.raw
  modified_base (413)..(413): a, c, t, g, unknown or other
  misc_feature (413)..(413): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtctcaggggacagagccaccctctcctgcagggccagtcagagtattaacaactgcgcagcctggtgccaaacaaaaacctggccaggctccaggctcctcatctttgatgcctcaatacgggtccctggcgtccagccaggttcagtggcaggtggtcgtggggacaggacttcactctccaccatcagcagccgttggacgcctaggaagtagtttttggtnttttaagttacgtgtactaaggtaacccgttgacctaacgttcggttaactcgttttacgggacccgtaagggggaaccctaaggtaccgttagggaacgtacgttaacgaaaggtacccggtaaacgtgggttacgggtccgttcgacccggtaacccctagttacccttaggttccctttacgtaacctttccccgtttacccccgtactacgttacccg

SEQ ID NO: 100634 - DNA, 614 bp, Homo sapiens
  misc_feature: GYAE6OF01C8Q79.23.37.D04.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngcccaccctctcttgcagggccagtcaagacattaggaactacttagcctaggtaccaacagaagcctggccaggctcccgaggctgctcatctatgatgcatccagcagggccagtggcatcccagccaggttcagtggcagtgggtcgtgggacagacttcactcnccaccactcccgcacgtccctaggacnccgtagaacgtcgtttggtaccgggttttattacgtgtaacctaaaccgtaaccgtacccaacgtcggtcccttccgttacgtttcgggtaccgtttaccggggaccgaaacggggtaccaaacgggttacggaaaacgtaccgaaaaacgacgttggtcggtactcggactacctatcgttacgttctttacgactttcccgtcccgtctaacg

SEQ ID NO: 100635 - DNA, 657 bp, Homo sapiens
  misc_feature: GYAE6OF01EDUQD.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgtcttcgtccccgaaggggaaagagccaccctctcttgcagggccagtcaagacattaggaactacttagcctggtaccaacagaagcctggccaggcctcccgaggctgctcatctatgatgcatccgagcgacgggccacgtcggccactccccgagtccgagggttccagggtcgggactagggtcggggtcgtaggggaaccaggtaccttaccaccttcacctaaccactcccgacacgccctaggacgtccgtagaagttacgtttggtacgttttattacgtagtacctaaacgtaaccgtacctaacgtcggtaccccgttccgttacgttcgggtaccgttaccgggaccgtaacgggaaccgtaagggtacgaaacgtaccgaaaaccgtacgtcgggtacgtccgtagaccctacgtacgttcgttacgttccttacctacttccccgttccccgacccgtac

SEQ ID NO: 100636 - DNA, 559 bp, Homo sapiens
  misc_feature: GYAE6OF01AHV46.23.37.D04.1.454.CMB.1.raw
  modified_base (526)..(526): a, c, t, g, unknown or other
  misc_feature (526)..(526): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcgacgggccacgtggcactcccagccaggttcagtggcaggtggtctgggacagcttcactctacaccatccgcacgcctagacgtcctgaacgttcgtttggacgttttatactgtacaacgtaacgtaccacgtcgcccttcgtcgttaggaccgttcggaccgaagggaccaaggtagaaactcgaaacgtacgtggtcggctggacctacctntccttgtccttctacttcccgttcccgctaacg

SEQ ID NO: 100637 - DNA, 582 bp, Homo sapiens
  misc_feature: GYAE6OF01EXPKS.23.37.D04.1.454.CMB.1.raw
  modified_base (351)..(351): a, c, t, g, unknown or other
  misc_feature (351)..(351): n is a, c, g, or t
tcagacgcgagtatcacgaccggtgctcgatttagtagcatactgttgtgtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaagagccaccctctcttgcagggccagtcaagacattaggaactacttagcctggtaccaacagaagcctggccaggcctcccaggctgctcatctatgatgcatccagcagggccactggcatcccagccaggttcagtggcaggtggtcngggacagtacttcactctccacatccgcacgtcctagacgtccgtagaacgtacgtttggtacggtttattacgtcgtacctaaccgtaaccgtaccaacgtcgtccctccgttccgttacggtaccgtttccggaccgtaacgggaccgtaacgggtagaaacgtacgaaacgacgtaggtcggactacggcaaccctagtctacgttcttactacttccgtcccgtacc

SEQ ID NO: 100638 - DNA, 804 bp, Homo sapiens
  misc_feature: GYAE6OF01CTXIY.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccaggggaaagacgccaccctctcttgcagggccagtcaagacattaggaactacttagcctggtaccaacagaacgcctggccaggcctcccgaggctgctcatctatgatgcatcccagccgacgggcccagtcggaccacgtccccaggtcccgtagggttcaggttggaccgtaggggttcggggtccgtaggggacctaggtaccctttccaccttccgtaccacccgacgttacccggacaaccgtacccgtacggaccgtacccgttaaggtaaaccggtttaccgttttacgggtaccgggttttttaacttaccgttacgggttaacccaaaacccgttaacccgttaaccccgtaaaccgttcccggggttacccccttacccgggtttacggtttaaccggggttacccggttttaccccggggaaacccgggtaaaccgggggtaacccgtaaacgggggttacggaaaaaccgttacccggtaaaaaccggtaccgttacggggtacggtaccgttacggaaccctaacccgttcgttacccggttcgtttacccgtttaccgtacctttcccccgttcccccggtactttaacccgg

SEQ ID NO: 100639 - DNA, 609 bp, Homo sapiens
  misc_feature: GYAE6OF01BPKMP.23.37.D04.1.454.CMB.1.raw
  modified_base (352)..(352): a, c, t, g, unknown or other
  misc_feature (352)..(352): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgcccagggaaagagccaccctctcttgcagggccagtcaagacattagaactacttagcctggtaaccaacagaagcctggccaggctcccgaggctgctcatctatgatgcatccagcgaggccagtgactactcccagccaggttcagtggcaggtgggtcngggacagtacttacacgtctcactactcgacacgcctagacgtcctagactacgttgtacgtttatacgtgtaccaacgtaacgtacctaacgtcggtaccctcggttctacgggtaccgttccggaccgtaacggggtacctaaagggtacggtaaaactacgtaaaaccggtaactgggtacgggtacctggaacctaaccgttattaccgttcgttaccctttacaacgtttcccgtaccccggtacttaaccg

SEQ ID NO: 100640 - DNA, 599 bp, Homo sapiens
  misc_feature: GYAE6OF01BSWKM.23.37.D04.1.454.CMB.1.raw
  modified_base (568)..(568): a, c, t, g, unknown or other
  misc_feature (568)..(568): n is a, c, g, or t
  modified_base (594)..(594): a, c, t, g, unknown or other
  misc_feature (594)..(594): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccaggggaaagcgccaccctctcttgcagggccagtcaagacattaggaactacttagcctaggtaccaacagaagcctaggccaaggcctcccgaggctgctcattctatgatgacactccgagcgacgggccacgtggacactccgagccgtaggttcagtcggcgtaggtcgggtcgtagggacagtacttcactctacacctagtccgacacgcctagacgtcctagtaacgtacgtttcggtacgtttaattacgtcgtaccaaaccgtactaccaagttccgaccgttcgtacgttgggaccgttcggaccgtaagggaccgtaaggtacgaaacgtacgaaacgtcgtaggtcggctaggcctaacgntcctgttactacacttcccttcccgntaacg

SEQ ID NO: 100641 - DNA, 645 bp, Homo sapiens
  misc_feature: GYAE6OF01DLGH8.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgtgtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaancgcccacctctctgcagggccagtcaagacattaggaactacttagcctggtaaccaacagaagcctggccaggcctcccgaggctgctcatctatgatgcatccagcgacgggccacgtcggcactcccgagccgaggttcaggtggcaggtgggtctgggacagtaccttcacctctcgaccatcccgacacgtaccgtagacgtccgtaggtaaacgttacgtttcggtacggtttttactacgttacgtaacaaacccgttaaccgtaacctaacgttccgggtcccttacccggtcgtttacgggtaccgttacgggaaccggaacgggtaaccgaaggtaacggaaacgtaccgaaaacgtacgtcggtacggtactacggacctaccgtagttccgttacggttaccttacgtaaccgttcccttcccggtaccc

SEQ ID NO: 100642 - DNA, 782 bp, Homo sapiens
  misc_feature: GYAE6OF01CYM52.23.37.D04.1.454.CMB.1.raw
  modified_base (262)..(262): a, c, t, g, unknown or other
  misc_feature (262)..(262): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagcgccaccctctcttgccagggccagtcaagacattaggactacttagcctggtaccaangaagctggccaggctccaggctgctcatctatgatgcatccagcgagggccacgtggccactcccagtccgtaggttccaggtcggaccgtaggttcgggggtacttcgggggaactacggtaccgttttaccaaccgtttccgtaaccgtaacccctacgttacccccgggactaacggtaccccgttaagggaaaccggtccccgtttaagggaaaccggtttaccgtttttacggtacccgggttttttaaattacccgttacggttaaccccttaaaaccgtaaccccggttaaacccgtaaccgttccgggtacccctttacccggtttacccgtttaacggggtacccgttttccgggggaaccccgtaaacgggggtaccccgtaaaggggttccggtaaaaattacccggtaaaaccggtaccgttggtaccgggtacgtacgtacctaacccgtagtttaccgtcggtttaccctttaccgaccgtttcccgttcccccgtacggttaacc

SEQ ID NO: 100643 - DNA, 623 bp, Homo sapiens
  misc_feature: GYAE6OF01BMRU7.23.37.D04.1.454.CMB.1.raw
  modified_base (218)..(218): a, c, t, g, unknown or other
  misc_feature (218)..(218): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccacggagaaattgtgttgacacagtctccagcccaccctgtctttcgtccccgaaggggaaacgacgcccaccctntcttgcgagggccagtcaagacaattaggaactacttagcctaggtaaccaagagaagcctggccaggcctcccgaggctcgctcatctatgatgcagtccaggcgagggacccacgtggcctaactccccgagacccgtaggtttcaggttggactagggtcgggtccgtggggaacagtaccttcacctctacaccatccgacagcctaagacgcctaggtaatcgtttgtacggttttaatacgtctaccaaactaacgtaccaacgtcgtcctaccgtcgttcgggaaccgttcgaaccgtaacgggaacgtaagggacgtaaagtaaccgaaaccgaacgttggtaggtacctgaactaccgtatcttcgttacttactaccttcccttcccgcctaacg

SEQ ID NO: 100644 - DNA, 1000 bp, Homo sapiens
  misc_feature: GYAE6OF01DRLK7.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagacgaccacggagaaattgtgttgacacagtctccagccaccctgtctttgtccccgaaggggaaagacgcccaccctctcttgcgagggtccagtacaaagacctaagttaacggaactacgttaacgccttacggtaaccaaaacgacgaaacggtcccgtaggacccaacgggcccttacccgaaggggtccttcggacctcctaaattccttaaagttggaacgttcggacctaacgttcccgaagaccggtacggggaccctaacggtgggaccaacgttccccaaggtcccgtaagggtttccgaaggtcggaccgtagggttgggtacctgggggaaacctaggtacctttacaaccgttccgttacccaaaacccgttcgtaccccggacgtaaccggacccgtttaaaccgggacggacccccgtttaaaggggtaaaacccggttttcgtttttaaccggggttaccgggttttttaaaaccttttaaccgggttaccgggttaaacctaaaaacccggttaaaccccggttaaaccctaaacccggtttaccggttaccccctttaacccggggtttgtttaaccgggggttaaccccggttttaacccgggggaaccccgggtaaaaaaccgggggttaaaccccggggtaaaaagggggtttaacccgggggtaaaaaaaccctttaaaacccggtaaaaaacccggggttaaaaccgtttccggggttaaccgggttaaaccccggtacgggttaaccctaaaaccccggtatttttacccgggtactttttaacccgttaccctttaaaccggttttcccccggttaaccccctacgggttaaaccc

SEQ ID NO: 100645 - DNA, 684 bp, Homo sapiens
  misc_feature: GYAE6OF01BQBPV.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccagggaangccaccctctctgcaggccagtcaagacattaggaactacttagcctggtaccaacagaacgcctaggcccaggcctcccgaggctgctcatctatgatgcatccagcagggccacgtggccacgtcccagcccgtaggttcaaggttcggactagggtgggtcgtaggggacacggtacttccgacttcctaccgaccctacgtcccgacgacgtacccttaggaccgtaccgtacggtaacgttaccgttttaggaccggtttttaacttaccgttacgtaacccgtaaacccgtaaccgttaacccgtaacgttccggttaccccgtaccggtttccgttacgggtacccggtttcccgggaaccggtaaacggggtacccaaagggttcggaaaacgttaccgaaaacgtacgttggtacggccttaggacctaccgtacttcgttacgtcctttacaccgtttcctccccgtcttacg

SEQ ID NO: 100646 - DNA, 531 bp, Homo sapiens
  misc_feature: GYAE6OF01BXPBQ.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgtgccgactccttggcctggtaccaacaaaaacctggccagcctcccagctcgtcattcatggcacatccaacagggccactggcatcccaggccaggttcagtggcagtggctcgtgggacagacttcactctcacgatcagcagtgtcgaccctgacgtattttgctagtttattactgtcagtcaacggtgcgcctggtacctagtcaccgtttcggccaagggcctcgacgttggacgtagtacggaaacgaactgtacgggcttaggccctaccaatcttcggtctttaccg

SEQ ID NO: 100647 - DNA, 685 bp, Homo sapiens
  misc_feature: GYAE6OF01B3NQG.23.37.D04.1.454.CMB.1.raw
  modified_base (205)..(205): a, c, t, g, unknown or other
  misc_feature (205)..(205): n is a, c, g, or t
tcagacgcgagtatcacgaccggtgctcgatttagtagcatactgttgggtttgggggaggaactactcagttaggacccagagggaaccatggaagccccagctcagcttctcttcctcctgctactctggctcccagagaccaccggagaaattgtgttgacacagtctccagccaccctgtctttgtccccaggggaaaaangccaccctctcttgcagggccagtcaagacattaggaactacttagcctggtaccaacagaagcctggccaggctcccaggctgctcatctatgatgcatccagcgagggccactggcactcccagccaggttcagtcggcaggtgggtctgggacaggacttcacgtcctccaccactcccgagtacgacccgtagacgtaccgtaggaaacgtaaccgttttggtaccggtttttaactttaccgttaggttaacctaaacgtaaacccgttaaccctaaaccgtcgggtaccccgtttaccgttcgtttacgggtaacccgtttaccgggacccgtaaacggggaacccgtaaaggggtacggtaaaacgtaccggtaaaacgtaacgttacgggtacggtacgtccgaccgtaccctacgttccgtacgttacctttccgaactttaccccgtttaccccgtccgtaacgttaccg

SEQ ID NO: 100648 - DNA, 554 bp, Homo sapiens
  misc_feature: GYAE6OF01D77JI.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcagggccacgtggcatcccagccaggttcagtggcaggtggtctgggacagtacttcactctaccaccatcccgctagcctagacgctgaagtctttgcggtttattacgtgtacaactaacgtaccaactcgtcctcgtcgttaggacgttccggaccaacggggaccaagggtacggaaactacaaaacggactggtcggctggacctaccattctcgttcttacacttcccttcccgctacg

SEQ ID NO: 100649 - DNA, 1039 bp, Homo sapiens
  misc_feature: GYAE6OF01A2O55.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggcctccagagaccaccggagaaattgtgttgacacagtctccagccacccttgttctttcgtaccccgaaggggaaacgacgcccaccctcttcttcggcgacgggccaaggtcaaacgaactaagtttaacggaaaccttacgttacgcccgttacggtaaccaaacgaaggaacgtcccgttagggcccaacgggtccttccccgaagggtccttacggcctttacctaattacccgttaagttcggaaacttcgggacctaacgttaccccgaaaggtacccggaacggggggtaccccctaaaccgttcggggaccctaaacccgttccccccgaacggtaccccgttaaggggtttcccaaggggtttccgggaccggttagggggtttcggggtaccggttaagggggtaaccctaaggttacccgttttaccacccgttaccttaacccgtaaccccgactttacccccgggacgtaccggtacccgttaaaccggaccgttaccccggtaaaggttaaacccggtttaaccgtttttacgggggttaaccggttttttaaaccgtttacccgttaacgggtttaaacccaaaaacccgtttaacccggttaaacccccttaaacccggttccgggtttacccccgtttacccggtttaccggggttttaaccgggtacccggggttttaacccggggaaaccccgggtaaaacgggggtaaacccgttaaacggggtacgggtaaaaacccgttaaaccggtaaaaaccggttaccggttaggggttaaccccgggtaccttaccggtaaacccgttaaccgggtaccctttaccggttacgtttacccgttttacctaacccgtttttcccccggttaccccggttaccttaaacccgg

SEQ ID NO: 100650 - DNA, 734 bp, Homo sapiens
  misc_feature: GYAE6OF01B9O2P.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccacggagaaattgtgttgacacagtctccagccaccctgtctttcgcccgaagggaaagacgcccacctctctgcgacgggccagtacaagactagttaacggaacttacttacgccgtacggtaaccaaacgagaacgccgtggaccgaggcctcccgaggctcgctcgattcgtatcgatcgaccactccgaggcgacgggacctacgtcggacctaaccgtcccgacggtaccgtaacgggttcgaacgggttcggacgtacgggttcgggggtaccgtaggggaacctacggtacctttacgaccgttcctaccaccgtaccgtcccggacgtacgaccgtaaggaccgtccttaaaggtaacgttccggttttaggtaaccggttttaactaccgttaagtaaacccgaaaccgtaaacccgttaaccgaacgttccggtaccctttcggttacggttacgggtacccgttacgggaacggtaaacgggtaacgtaagggtacgtaaaacgtacgaaacgtacgttcggacggtctaggacctacgtactacgttcgttacctactacctccccgttcgcgttaacg

SEQ ID NO: 100651 - DNA, 824 bp, Homo sapiens
  misc_feature: GYAE6OF01DFHVD.23.37.D04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccaaggggaaanacgccaccctctcttgcagggccagtcaagacattaggaactactagcctggtaccaanagagcctggccaggcctccaggctgctcatctatgatgcatccagcgagggccaacgtgggaccacgtccccgacgtacccgtagggtttccaaggtttcggaccgtacgggtttacgggggtaccgttacggggggaacctaacgggtacctttaccgaacccgtttccgtaacccgtacccgtaacgttccccggaccgaaccggtacccggtaaggtaacccggtacccgttaacggtaaaccggtttacgttttacgggttaaccgggtttttaacgttttaccgttaccggttaaaccgtaaacccgtaaaccggtttaaccccgtaaacggtttacccgggtaccccgtttacccggtttaaccggttttacgggttaacccggttttacccggggtaacccggtaaacggggtaacccggtaaacgggttacggaaaacggttacccgtaaaaccggtaccgttacgggtacggtaccgttacggacccgtaaccgtacgttaccgttacgtttaccttacccgttacgtttccccttccccggtccgttaaccg

SEQ ID NO: 100652 - DNA, 561 bp, Homo sapiens
  misc_feature: GYAE6OF01D2X40.23.37.D04.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggactacttagcctggtaccaacagaagcctggccaggcctcccaggctgctcatctatgatgcatccagcgagggccactggcacgtcccagcctaggttcaggtggcaggtgggtctgggacaggccttcactctcaccntccgcacgcctagacgctagaacgtactttggacggttttattacgtgtaccaactaaccgtaccaacgtcggcccttcgttacgttcgggacgttccggaccgaagggtaccaagggtacgaaataccgaaacgactggtacggctgaccacagtctcgttctacactccgtcccgctac

SEQ ID NO: 100653 - DNA, 752 bp, Homo sapiens
  misc_feature: GYAE6OF01C70GD.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccgaaggggaaacgacgcccacccttctcttgccgagggccagtcaagacaagttaggaactacttagcctaggtaaccaacagaacgcctaggccaggcctcccgaggctgctcatctatgatcgctactccagcgacgggcctacgtcggacctacgtaccccgacgaccgttaagggttccgaggttcggacgtaaggggttcggggtccgtaggggaacctaacggtacctttccaaccgttcctacctaacccgtacgttcccggaccacggtcccttaagggacccgtaccggttaaggtaaaccgtttccgttttacgggttaaccgtttttaacttaaccggtacgttaaacccgtaaaaccgtaaaccggttaaccctaaccggtcgggttaccccttaccgggtttcgtttacgggtacccgttaccgggaaccgtaaacggggtacctaaaggggtacgaaaaccgttaccgaaagtaccggttggtacggacctacggacctaccggacttcgttcgttacctttacaccttcccgtccctactacg

SEQ ID NO: 100654 - DNA, 680 bp, Homo sapiens
  misc_feature: GYAE6OF01A7N1G.23.37.D04.1.454.CMB.1.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagacattaggaactacttagcctggtaccaacagaagcctggccaggctcccgaggctgctcatctangatgcatccagcagggccacgtgcancccagccaggttcagtgcagtcggctgggacagtacttcactctacacccagtccgactacggtcctacggacgtcccgtaggtaaaccgtacttttacggtacggtttttattaccgttggtaaccaaaccgtaaccgtaacctaaccgttcgggaccctttcccggttacgtttacgggtacccggtttccgggaacccggtaaacgggggtaaccctaaacggggttacggaaaaaccttaccggtaaaaaccgggtaccgttagggttacggggtacctacgggtaccctaaaccgtacttcccgttacggtttcccttaccgtactttaccccgtttcccccgacgttaacg

SEQ ID NO: 100655 - DNA, 733 bp, Homo sapiens
  misc_feature: GYAE6OF01DSTZ5.23.37.D04.1.454.CMB.1.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctcagccacctgtctttgtcccagggaangccacctctcttgcagggccagtcaagcataaggaactactagcctggtaccaanagaacgcctggcacggcctaccaggctgctcatctatgatgcactccgagaccgacgggacctacgtggaccactccccgagtacccgtaggttcagggtcgacgtacggtggggtcgtacggggtacaaggtcctttacgaccttccgacctaaccgtacgttcccggactaaccggtacccgtaagaccggtacccgttaggtaaaccggtttaccgttttggttaaccggttttaactttaccgtttacggtaaccgttaaaccgtaaacccgttaacctaaccgttccgggtacccgttccgttccgttacgggtaccggttaccggaaccggtaaaccgggaccgtaacgggtacggtaaaacgtacccgtaaaaacggtaccgttagggtaccggtacgtaccgtaccctaccgtaccgttaccgttaccggtcttttacccacgtttaccccgttccccgtcccgttaacccg

SEQ ID NO: 100656 - DNA, 751 bp, Homo sapiens
  misc_feature: GYAE6OF01APU0N.23.37.D04.1.454.CMB.1.raw
  modified_base (205)..(205): a, c, t, g, unknown or other
  misc_feature (205)..(205): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccgaggggaaagngccaccctctcttgcaggccagtcaagacattaggaactacttagcctggtaaccaacagaacgccgtaggaccagggtcctacccgacggtcctggcctacgactctatgatcgcagtccagacgacgggacctagtcggacacgtccgacgtccgtagggttccaggtcggcgtagggttcgggtacgtagggggactacggtaccttcaccttctaccacccgtatccccgactcggaccctagacgtcccgtaggtaacgttacgtttgggtacgtttaacttacgtacggtaactaaaccgtaccggtaaccctaaccggttccggtaccctttaccggtccggtttaacggggtaaccccggttacgggtaaccccgggtaaaacgggtacccggttaaacggggtaaccggtaaaacgtaacccggaaacgggttaaaccggttccgggtaagggtccccttaggccctaaaacccggttcgtttaccgttacgtacccgtttaccaacccgtttccccgtttaccccgacgttaaccg

SEQ ID NO: 100657 - DNA, 868 bp, Homo sapiens
  misc_feature: GYAE6OF01DMIYN.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgttctttcgtccccgaaggggaaagacgcccaccctctcttcgcgacgggccagtcaaagacattaaggaacttacttagcctaggtaccaacagacgcctggccaggcctaccaggtctgctcatctatgatgcactccagccgagggtcccagtcggacctactcccgacgtcctaagggttcagggtcggacgtaggttcgggggtcgtacggggaacctacggtaaccctttccaaccgttccctaccgaacccgtacgtccccgggaactacggtacccgtaaggtaaccggtaccccttagggtaaaccgtttaccgttttacgggttaccggtttttaaacgtttaccgttaccggttaacccgtaaaaccccgtaaacccggttaaccccgttaaacccggtttacccgggttaccccgttttacccggggtttacccgttttaccggggggttaaaccccgggttttaccccgggggaacccggttaaaaaccggggggttaaccccggtaaaacgggggttacgggaaaaaacccgtttaaacccgggaaaaaccggttaacccgggttacgggttccggtaaccgttaccgggaacccttaacccgttaacgttacccgtttcggtttaccctttacccgtacccgttttacccgtacccccgtccttaaaccg

SEQ ID NO: 100658 - DNA, 657 bp, Homo sapiens
  misc_feature: GYAE6OF01EC0K3.23.37.D04.1.454.CMB.1.raw
  modified_base (607)..(607): a, c, t, g, unknown or other
  misc_feature (607)..(607): n is a, c, g, or t
  modified_base (626)..(626): a, c, t, g, unknown or other
  misc_feature (626)..(626): n is a, c, g, or t
  modified_base (653)..(653): a, c, t, g, unknown or other
  misc_feature (653)..(653): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccacggagaaattgtgttgacacagtctccacgcccacccttgttctttcgtaccccgaaggggaaagacgccctaccctcttcgttggcgacgggcctagtacaaagactaagttacggaaacttactacgtccgtaggtaaccaaacgagaacgccgtaggacccgaggcctcccgaggtctcgctcattctagtgatcgcactccgagcgacgggccacggtcgacaccgtccgacgtccgtaggtcaggtcggcgtagggtcgggtcgagggactacggtaccttcactcctacaccacgtccgactacgtacccgagacgtcctaggtaacttcgtttagtacgttttactacgtacgtaaccaaaccgtaccgtaaccacggttcgtcccttacggttcgtaccgggtaccggttcgggaaccgtaacgggacctaagggtacgaaactacgaaagtcgnggtacgctacgctaacgtnttcctgttcctactaccttccgtcccntacg

SEQ ID NO: 100659 - DNA, 764 bp, Homo sapiens
  misc_feature: GYAE6OF01DR9SJ.23.37.D04.1.454.CMB.1.raw
  modified_base (213)..(213): a, c, t, g, unknown or other
  misc_feature (213)..(213): n is a, c, g, or t
  modified_base (755)..(755): a, c, t, g, unknown or other
  misc_feature (755)..(755): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagacaccacggagaaattgtgttgacacacgtcctccacgccctacccttgttcctttcgacccgaggggaaacnccgccaccctctctgcgacgggccagtacaagactaagttaacggtaaccttacgttacgccttacgggtaaaccaaacgaaggaaccgtccgtacggacccgacggcccgtacccgaggcttacgcctactattccttagtcggaactcgactaacgtccgaacgccggtaaccgggcacgtacggacctacctaccgacgtccgtacggttacgaggttaggccgtaggggtcggttcaacgggacttacggtactccgacttaccgaccgtaccacgtccccgagaccgtaccgtaaggcgtaccgtagtaacgtttcgttacggtttacgtttaacttacgtaacgtaaccgaaaccgtaacccgtaaccgtaactccggtaccgtccgttaccgggttacggtacccggtaccggtaaccggaacggggttaacgaacgggttaacgaaaacgtaccgtaaacggtacgtaccgtacgggtctaccgaaccgtacttaccgttcttaccgttcttaccctaggttaccccttcccgngttaacccg

SEQ ID NO: 100660 - DNA, 790 bp, Homo sapiens
  misc_feature: GYAE6OF01DQJLE.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagacgaccaccggagaattgtgttgacacagtctccagccacccttgttctttcgtaccccgaggggaaagcgccctaccctctcttcgcgacgggccagtacaagactaagttacggaacttacttagccgtacggtaaccaaacgaggaacgccgtcggaccacgggtcctacccgaggcctcgctcacttctagtacgtatcgctacgtaccgacggaccgacgggaccacgtcggaccacctacccgacgccgtacggtacagggtcggtcgtacgggtcgggtcggtacgggaacgtacgtaccttacgaccttcaccacctacgttccggacaccggtcgtaaggaccggtacgtaacgttaacgtttacggtttcgtttacgtttaacttacgtacggttaacctaaaccggtaaccgttacccgtaacggttcccgggttacccttaccgggttttcgggttaaaccgggtcccgggtttaaccgggaaacccggtaaacgggggttaaccgtaaggggttaaccggtaaaactaaccggtaaaccggtaaacggttgggacccgaccgttcggaacccttccgttagttccccgtttacgttacccctttaacgtaccttttcccccggtaaccacctttaacgg

SEQ ID NO: 100661 - DNA, 789 bp, Homo sapiens
  misc_feature: GYAE6OF01CKPEI.23.37.D04.1.454.CMB.1.raw
  modified_base (299)..(299): a, c, t, g, unknown or other
  misc_feature (299)..(299): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccgaggggaagagccaccctctcttgcagggccagtcaagactattaggaactacttagccttggtaccaacagaacgccgtggcccaggcctcccaggctgcctacntctatgactgcatccagcgacggccacgtcggcactcccgagcccgtaggttcgacggtcggacgtaggttggggtccgtaggggaactacggtactttccaccgttccgtaccacccgtacgtccccgtaccgaaccgtacccgttaacggacgtaccccgttaagggtaacgttaccgttttagggttaccggttttaacttacccgttagttaaacccgtaaaccgttaaacccgttaaccctaaaccgttcgggtacccccgtttaccggtttccgtttacggggttaacccggttacccggggtacccggaaaccgggtaacccggtaaacggggttaaccggtaaaacgttaacccggtaaaacccggtaacggttacggttaccgggtaccgttacggaccccttaaccgtaccgtttacccgtttacgttaccttttacccgaaccttttcccccggttaccccgtaccccgtttaaaccgg

SEQ ID NO: 100662 - DNA, 732 bp, Homo sapiens
  misc_feature: GYAE6OF01BKRRW.23.37.D04.1.454.CMB.1.raw
tcagacgcgagtatcacgaccggtgctcgatttagtagcatactgttggggtttgggggaggaactgctcagttaggacccagagggaaccatggaagccccagctcagcttctcttcctcctgctactctggctcccagagaccaccggagaaattgtgttgacacagtctccagccaccctgtctttgtccccgaggggaaagacgccaccctctcttgcgagggccagtcaagacattaggaactacttagcctaggtaccaacagaacgccgtggccaggcctacccgaggctgctcatctatgatgcactccgagcgacgggccacgtcggcactcccagccaggttcaggtcggcagggtcgggtcgagggtacagtactttccgacttcccgtaacaccccgtacgttcccggaccgtacgaccctaaggaaccgtccgttaaggtaacggttaaccttttgggtacggtttttaactaccgttacgtaaccctaaaaccgtaacccggtaacctaacggtccggtcccgttacccggttagttacggggtaacccgggttccgggaaacccggtaaacggggtaacccgaagggttaacgggaaaaacttcccgggaaaaacgttacgttaaccgggtgggtaccttacggaccctaaccgttagtaccccgtttacgtttacccgttacttaacccgtttccccgttaccccggtcctaacgg

SEQ ID NO: 100663 - DNA, 692 bp, Homo sapiens
  misc_feature: GYAE6OF01C3V6A.23.37.D04.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (328)..(328): a, c, t, g, unknown or other
  misc_feature (328)..(328): n is a, c, g, or t
  modified_base (671)..(671): a, c, t, g, unknown or other
  misc_feature (671)..(671): n is a, c, g, or t
  modified_base (680)..(680): a, c, t, g, unknown or other
  misc_feature (680)..(680): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactcgtggcctccagacgaccaccggaagtaaattgtgttgacacagtctccacgccacccttgtctttcgtcccgaaggggaaancgcccaccttntcttgcacgggccagtacaaagactaattaacggaacttacgttaacgccgtacggtaaccaagagaacgcctcggaccacggcctcccgaggtctgctcatctangatcgcactccaagccggacggccacgtcggacaccgtccgacgctacggtcgaggtcgacgtagggtcggtacggtcgggaactacggtactacctacgttcccgtacaccgtaacgtccggtacacgtccgaagtccgaccgttaggaacgtttcgtttacggttaacgttttaacttacgtacgttaaactaacctaaaccggttacctaacgttcggtacccttcggtttcgtaccgggttaccgttacggaccggtaaagggctaaagggttacgaaagtaaccggtaaacgacgttaggtacggtctacggacctctaccgtacgttcgtccttacncgtttcccncctacgttaccg

SEQ ID NO: 100664 - DNA, 773 bp, Homo sapiens
  misc_feature: GYAE6OF01CN1Z8.23.37.D04.1.454.CMB.1.raw
tcagacgcgagtatcacgaccggtgctcgatttagtagcatactgttgggtttggggggaggaactgctcagttaggacccagagggaaccatggaagccccagctcagcttctcttcctcctgctactctggctcccagagacccaccggagaaattgtgttgacacagtctccacgccaccctgtctttcggtaccccgaaggggaaagcgccctaccctctcttgcgaggccagtcaagacattagactactagcctaggtaccaacagacgcctggccgaggcctccgaggctgcctacattctagtgtatgcactccaggaccgacgggccacgtcggccaccgtccccaggccgtaacgggttcgtaagggtcggtaccgtaggggttcggggtaccggtaggggtacctaacggtacctttaccaccgttccctacccgaaccctaccgtcccgaccgaaccgtaccgtaacgggacgtaccccgtagggttaaacgttacggttttacggttacgggtttttacttaccgttacgttaacccgtaaaccgtaacccgtaacccgttaccggttccggtaccccgtttaccgggtttccggttaaccggggttaccggtttacccggggtaaccggtaaacggggtaacccgtaaggggttacgaaaaccgttacgaaaccggtacgtcgggtacggtaccgtacgaccctacccgttagtcccgttacttccttaccgttacctttccccttcccggccttaccg

SEQ ID NO: 100665 - DNA, 853 bp, Homo sapiens
  misc_feature: GYAE6OF01DHTBW.23.37.D04.1.454.CMB.1.raw
  modified_base (207)..(207): a, c, t, g, unknown or other
  misc_feature (207)..(207): n is a, c, g, or t
tcagacgcgagtatcacgaccggtgctcgatttagtagcatactgttgggtttgggggaggaactgctcagttaggacccagagggaaccatggaacgccccagctcagcttctcttcctcctgctactctggctccagagaccaccggagtaattgtgttgacacagtctccacgccctacctgtctttcgtcccgaaggggaaancgccacctctcttgcgacggccagtacaagacagttaaggaacttactacgccgtaggtaaccaacgagacgccgtacggccacggccctcccgaggtcctcgtacctactacgttactaacgtgaacgtcgaccgtaacgtaccgaacggtccggaaaccgggcccgtaacggtacgggacccgtaacctacccccggaacggtacccggttaacgggttccggaacgggttcggggtaccggtaaggggtttcggggttaccggtacggggtaaccgtaacggttacccttacgtaccgttacctacccgaaacccgttacgtaccccggaccgtaaccggtacccgttaacggaaccggtacccgttaaaggttaaacggtttccgttttaacgggttaacgttttaccttaaaccgtaccggtaaaaccctaaacccggtaaaccgttacccgtaacggtttcccgtaaccccgtttcggttaccggttaccggggtaaccggttcccgaaacgggtaaaccggggtaaccctaaagggtaagaacccgtaaaccgaaacggtgtcgggtaacgtcctaccgaactacccgttagttcccggttactttctaccttaacccgttcccttacccgcgttaacg

SEQ ID NO: 100666 - DNA, 526 bp, Homo sapiens
  misc_feature: GYAE6OF01CA4BJ.23.37.D04.1.454.CMB.1.raw
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcaggccagtcaagacattaggaactacttagcctggtaccaacagaagcctggccaggctcccaggctgctcatctatgatgcatccagcagggccactggcatcccagccaggttcagtgcaggtggctgggacngacttcactctcaccatcccgcagcctagacncctagaacgtactttgcgttttatactgtaccaacgacgtaccaactcggccctcgtcttggacgttcggaccgaaggaccaaggtcgaaatcaaacgatggtgctagcaccgtatctgtcttacatccttcccgctacg

SEQ ID NO: 100667 - DNA, 601 bp, Homo sapiens
  misc_feature: GYAE6OF01CF0T1.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctaggtaccaacagaagcctggccaggcctcccaggctgctcatctatgatgcatccagcagggccatggcatcccagccaggttcagtggcaggtgggtctggggacagacttcaccttctcaccagtcccgacacgtcctaaggcgtcctagaaacgttctttggacggttttaattacgtgtactaaactaacgtaccaacgtcggacccttcgtcgttacgggtaccgtttcgggacctaaacggggaccctaagggtacgaaaacttccgaaaacgtaaccgtgggtacgtccgtagaccaaccgtattcgtcgttaccttacctattcccgttcccgcctaacg

SEQ ID NO: 100668 - DNA, 620 bp, Homo sapiens
  misc_feature: GYAE6OF01CXAIT.23.37.D04.1.454.CMB.1.raw
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccacgccacccgtgttctttcgtccccgaaggggaaacgacgcccaccctctcttgcgagggccagtacaagactagttaaggaacttactacgacctaggtaaccaaacgagaacgcctcggacccaggcctaccgaggcctagcctacatctangtatcgactatccgagccgacgggccacggtgacctactcccgaagccgtaggttcagggtcgacgtaggggtcgtcgtgggaacacgtactctactctaccactacncgacagcagcnctagacgttcgttaggtacgtttatacgtcgtaacaacgtaacgacctagtccgaccttcgtgtacggacgttccggacgaacggacgtaaggtagaacctaacgaaacgtattcgggacgtcgaccacctctacttccgttacgtacttacggtactccccgtttccgctaacg

SEQ ID NO: 100669 - DNA, 691 bp, Homo sapiens
  misc_feature: GYAE6OF01DDNU4.23.37.D04.1.454.CMB.1.raw
  modified_base (327)..(327): a, c, t, g, unknown or other
  misc_feature (327)..(327): n is a, c, g, or t
  modified_base (380)..(380): a, c, t, g, unknown or other
  misc_feature (380)..(380): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccgaggggaaagacgccaccctctcttgcagggccagtcaagacattaggactacttagcctaggtaccaacagaacgcctggccaggcctcccaggctgctcatctatgatgcatccagcgagggccactggcancccagcctagtcagtggctaggtcgggtcgtgggacacggactttcgacttcnccacctagtcccgcacgcccttaaggaccgtccgtaaggtaaacgttacgttttacggtacggtttttaattaccgtaggttaacccaaaacccgtaaccgttaaccccgtaaacgtccgggtacccctttccggttaccgtttacgggtaacccggtttaccgggaacccggtaaacggggtaacccgttaaaggggttacgggtaaaaacctacccgaaaaaccgggtaaccgttgggtacggacgttacgacctaacccgtattccgttacgttcccttacgtactttacccgttccccgtcctaacg

SEQ ID NO: 100670 - DNA, 795 bp, Homo sapiens
  misc_feature: GYAE6OF01BSK9V.23.37.D04.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagtaaattgtgttgacacagtctccagcccacccttgtctttcgtccccgaaggggaaanacgccaccctctctgcgngggccagtcaagacattaggaactacttgcctgtaccagagacgctggccaggtcctcccgaggctcgctnattctatgatgctactccaggccgacgggccacgtcggacctactcccgacggtcccgtaggttaccgaggtcggacgtacggggttcggggtacgtacggggacctaacgggttacctttaccggtaccttaccctaacccgtaacccgtaccgttccccggaaccgtaaccgggtacccgtttaacggaccgggtttaacccctaacgggggttaaaccgtttaaccgggtttttggttaacccggtttttaaacgtttacccgttaacgttaaaccccgtaaaaccgtaaaccccgttaaccgttaaccggtttcccggtaccccggtttacgtttccggttaccggggtaccggttacccgtaaccgggtaaacgggttaacccgtaaagggtaaaccgtaaacgtaaccggtaaaaccgtacgttcggtacgtcctcggaaccctcttccttacgtccgttcttaccgtacctttcccgtcccgtacttacg

SEQ ID NO: 100671 - DNA, 229 bp, Homo sapiens
  misc_feature: GYAE6OF01AG5Z2.23.37.D04.1.454.CMB.1.raw
  modified_base (219)..(229): a, c, t, g, unknown or other
  misc_feature (219)..(229): n is a, c, g, or t
tcagacgcgagtatcacgaccggtgctcgatttagtagcatactgttgggtttggggggaagaggaagactgacggtcctcccaggagttcaggtgctgggcaccttgggcacgggggaggtgtgtcacaagtatttgggctctgggcacagcggccctgggctgcctggtcaaggctacttccatactcgcgtctgagcgggctggcaggcgcatagnnnnnnnnnnn

SEQ ID NO: 100672 - DNA, 790 bp, Homo sapiens
  misc_feature: GYAE6OF01CUX2I.23.37.D04.1.454.CMB.1.raw
  modified_base (287)..(287): a, c, t, g, unknown or other
  misc_feature (287)..(287): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctccagagacccaccggaagtaaattgtgttgacacagtcctccagcccacccttgttctttcgtccccgaaggggaaacgcgcccaccctctcttcgcgagggccagtacaaagactaagttaaggaactacttagaccttaggtaacccaanagaacgcctacggacccgacggtccctacccgaaggtctcgaccttacaacttctagtcggactcgacctatcccgacgaccggaccggggccctaacgtcgggaccctaaccgtcccccgaacggtacccggtaacgggttccgaagggttcgggaccgtaggggtttcgggggtaccggttaggggaaccctaacgggttaccctttaccacccgttacctacccaaccgtaccctacccggcgtacggtaacccgttaaggaccggttaccctaagggtaaacgttccgtttttagggtaccgtttttaattccgtacgttaacccgaaaacgtaccctaaccaacggttccgcccgtttacgttcgttagggtaccccgttcgggacccgtaacgggacctaagggttacgaaaactaccggttaaacgcggtttgaccgtcgtacaccctaccgtcttcggttcccgtaacttccgtacctttccctaccccgtctac

SEQ ID NO: 100673 - DNA, 714 bp, Homo sapiens
  misc_feature: GYAE6OF01EA1FH.23.37.D04.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagacgcgagtatcacgaccggtgctcgatttagtagcatactgttgggtttgggggaggaactgctcagttaggacccagaggaaccatggaagccccagctcagcttctcttcctcctgctactctggctcccagacaccaccggagaaattgtgttgacacagtctccagccaccctgtctttcgtccccgaaggggaanacgccaccctctcttcgcacgggccagtcaagacagttaggaactacttacgcctggtaccaactagaagcctgccaggctcccaggtcngcctacacttctagtgatcgaccagtccaagtccgaacgggccctaccgtggccacgttcccccgaggtacctaagggttcccaggggttacggaccgtaagggttcgggtaccgttaggggacgttaacgtaccgttacacctccgtacaaaccgtctacccgcgtaacgtaccgtagaccgtccaaggtacgtcgtttacgtacggtttaattacgtagtacctaaacgtaaccgtacctaacgtacgtcccttaccggttacgttaccgggtaaccgttccgggaaccgtaaacgggtaacccgtaaggttacgggaaacctaaccggtaaaccgtaagttcgggtacggacttaccggactacccgttaatccgttacctttaccgtactacccgttccccgtcccgtcgtaaccg

SEQ ID NO: 100674 - DNA, 782 bp, Homo sapiens
  misc_feature: GYAE6OF01A3F4A.23.37.D04.1.454.CMB.1.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccaggggaaagagccaccctctcttgcagggccagtacaagacattaggaactacttagcctgaccaanagagctgcagctccaggctgctnatctangatgcataccagcgagggccagtcggacactcccgacgacgagttcgaacggtggacctagggtcgggtacgtggggaacctcgtacgtttcacccgttcctaccgaaccctaacgtcccgtaccgaacgtaccctaaggtaccgtacccgtttaacggaaacggtttaaccttttaccggggttaacgttttaaacggttttacttacggttacccgaaaacccgttaaaccgttaccccgttaaaacggttcccggtaaccccgttttacccgggtttacggtttaacccgggtaaccgggttccccgggggttaaaccgaaaccggggttaacccgtaaaggggtaaaccgtaaacggttaacccaaaacgggttaaacccggttaggtacgggtacccgttacggaacccgttaaacccgtcgttaaccgttaccgtttacggttaccccttaacgtttaccccggttcccccggttacccttaaacgg

SEQ ID NO: 100675 - DNA, 1000 bp, Homo sapiens
  misc_feature: GYAE6OF01D6JG5.23.37.D04.1.454.CMB.1.raw
  modified_base (213)..(213): a, c, t, g, unknown or other
  misc_feature (213)..(213): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggaagtaattgtgttagacactagtctccacgccctaccctgttctttccgtccccgaaggggaanacgcccacccttcttcttcgacgacgggccagtacaagactagtaacgaacttacgtacgccgtacggtaaccaacagtaacgccgtcggacccgaacggtccctacccgacggccttcggccttactaacttcctttaagtacgtacgttcggacctaacgtacccggaaggacccggaaccgggggtaccctaaccggtttaccgggaccctaaaccccgttacccccggaaccggtaccccggttaaaccgggttttccggaagggggttaccgggacccggttaagggggttccggggtttaccggtacgggggaaacctaaaccgggtttacccttacccgtaaccctttaccctaccccgtaaacccttaccccgggttacccgacccgtaaccgtaacccggttaacggtaacccggttaccggtttaacgggttaaaaacccggttttaccggttttacgggtttttaaccgggtttttaaccgttttaaccgtttacggttaaacccctaaaccggtaaacccgtttaaaccccgtaccggtttacccggttaccccggtttaccggtttacccgggttaccgggttaaacccggggtttacccggggtaaaacccggttaaaccggggggaacccgttaaacggggtaaaccggtaaacgttaaaacccgtaaaaccggtacgtacgggttaccggtaccggtacggtacctaacccggtactttacggtaccgtttccgtactttaacccgttcccttaccccgtccgttaacccg

SEQ ID NO: 100676 - DNA, 830 bp, Homo sapiens
  misc_feature: GYAE6OF01BV5M5.23.37.D04.1.454.CMB.1.raw
  modified_base (213)..(213): a, c, t, g, unknown or other
  misc_feature (213)..(213): n is a, c, g, or t
  modified_base (322)..(322): a, c, t, g, unknown or other
  misc_feature (322)..(322): n is a, c, g, or t
tcagacgcgagtatcacgaccggtgctcgatttagtagcatactggttgggtttgggggaggaactgctcagttaggacccagagggaaccatggaacgccccagctcagcttctcttcctcctgctactctggcctcccgagagaccgaccggagaattgtgttgacacagtcctccacgcccaccctgttctttcgccccgaaggggaacncgcccacctctctgcgacggccagtacaagactagttacggaactacgtagcctaggtaaccacaggacgtccgcggaccacggcctcccgaggcctcgctcatctagngatgacactccgagcggacggccagtcggaccaaccgtcccgacgtccgtacggttcgaggttcggacggtgggtcggggtacgtacgggactacggtaccttaccgtaccttccgaacctaccgtacgtacccgaccaccggtaaccgtaacggaccggtaacccgttaaggttaacccgtttacggttttacgggttaccgtttttaacgttaccgtaacgttaaacccgtaaccgttaaaacccggtaacccgttaaccggtacccgttacccgtttaaccgggtttccggtttaaccggggttacccggttacccgggtaaacccgggaaacccgggttaaacgggaacggggttaaacgtaaaccggtaaaacccgtaaacgggttaccggttaacgggttaccgaaccggttacccgaaccgtacccgtttaacgttacccgtttaccgttaccctttaacccgtacccgtttacccccgttaccccgtacgtttaccccgg

SEQ ID NO: 100677 - DNA, 657 bp, Homo sapiens
  misc_feature: GYAE6OF01A0000.23.37.D04.1.454.CMB.1.raw
  modified_base (488)..(488): a, c, t, g, unknown or other
  misc_feature (488)..(488): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccaggggaaacgacgccaccctctcttgcagggccagtcaagacattaggaactacttagcctggtaccaacagaacgcctggccaggctacccaggctcgctcgatctatcgatgacctatccgagcgaacgggtccaacgtcggacctacgtccccgacggtccgtaggttccaggtcggctagggtcgggtcgtaggggactaggtacctcgacttcgtaccaaccgtcgtcccgactacgaccttaggaacgtcccgtaaggaaacgttcgttttcggaacggtttttaanaccgtttgaacctaaacgtaaaccgttccaacggttcggacccttcggtacgttacgggaccggttcccggaacgtaacgggacctaagggtacgaaactacgaaacgtagtcgtaggcctaggcctaactcgtcttcgtaccttacgacctcccgttaaccgctaacg

SEQ ID NO: 100678 - DNA, 759 bp, Homo sapiens
  misc_feature: GYAE6OF01C5NK7.23.37.D04.1.454.CMB.1.raw
  modified_base (524)..(524): a, c, t, g, unknown or other
  misc_feature (524)..(524): n is a, c, g, or t
  modified_base (704)..(704): a, c, t, g, unknown or other
  misc_feature (704)..(704): n is a, c, g, or t
  modified_base (752)..(752): a, c, t, g, unknown or other
  misc_feature (752)..(752): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggaagtaattgtgttgaacacagtcctccacgccctacccttgttcctttcgtaccccggaaggggtaaacgacgccctaccctcgttcttcgacgacgggaccgagtacaaacgtactaagttaacggtaacttacgttacgtaccgtacggtaaccaaccgtagaacggccgtacggccgaacggccgtaccgacggccttcgcctactacgtacttagtcggtattacggactactaccgacggtaccggaacgggccctacggtcggaccctaccgttccccgaaccggtaccggttaacggttcgagggtcggacggtacggggttcgggtaccggtacgggactacggtaccttcgacctccaccacctacncccgactcgtacctacggtacgcgtaagtacgttaacgttttcggtaacttttacgtacctacggtaacctaaacgtaccgtaaccgtcgtacggttccgttaccgttcggttacggggttaccgtaccggacgggtaaggaaccgttaaggtaccgaactaaacgtaacgtagtcgggngtacgctaaccttacgacttcgtacttcccgtaatcccttcccgttcnccgtaac

SEQ ID NO: 100679 - DNA, 718 bp, Homo sapiens
  misc_feature: GYAE6OF01CKCCK.23.37.D04.1.454.CMB.1.raw
  modified_base (298)..(298): a, c, t, g, unknown or other
  misc_feature (298)..(298): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccgaggggaaagcgcccaccctctcttgcgagggccagtcaagacattaggaactactagcctaggtaccaacagaacgcctggcccaggcctcccaggctgctnatctatgatgcactccaggccgacgggccagtggcctacgtccccagccgtaggtcaggttcgcgtagggtcgggtcgtagggacctagtaccgttcgtacctccgtaccaacccgtacgtcccgagtaccgtccggttaaagccggtacccgtaggtaaacgttccgttttacggtaccggttttaattaccgtcgtaaacctaaaccgtaaccgttaaccccaagttcccgggtaccccttacgggttcgttaccgggtaaccggttccgggaacccgttaacgggggaaacccttaaggggaccgtaaaaacgtccggaaaacgtacggtaccggtagggtacccttacgaccgtaccccttagttccgttaccgttccttacctaaccgttttccccctacccgtacgttaacccg

SEQ ID NO: 100680 - DNA, 683 bp, Homo sapiens
  misc_feature: GYAE6OF01AX5BQ.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttagacacagtctccagccaccctgtctttcgtccccgaggggaaagcgccaccctctctgcaggccagtcaagacataggaactacttagcctagtaccaacagaacgccgtggaccaggcctacccgaggctcgctcatctatgatgcactccagccgacgggaccacgtcgggctactccccagcccgtaggttccaggtcggacgtaggtggggtaagtgggaactacgtacttacacctccgtacaccctacgcccgtacgacgccgtaacgcgacctaggtaaacgttacgtttagggtacgttttaacgttacttaacgtaccaaaccgtaacgtaacccttaacgtcggtaccctaccggttacggtttaccggtaccggttacccgggtaaccgaacggggtaccgtaaacgggtaggaaacctaacggtaaacgttaacgtcgggtcggtacgtcgtaccgaacctacttaccttcgtaccttcgtaacccttcccgttcccgtcgttaacccg

SEQ ID NO: 100681 - DNA, 741 bp, Homo sapiens
  misc_feature: GYAE6OF01AS0TC.23.37.D04.1.454.CMB.1.raw
  modified_base (301)..(301): a, c, t, g, unknown or other
  misc_feature (301)..(301): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagagacccaccggagtaaattgtgttgacacagtcctccacgccctacccttgttcctttcgtaccccggaagggggaaacgacgcccctaacccttcttcttcggccgacgggccagtacaaagtactagttaacggaactacgttacgcctaggtaccaanagaacgtccgtggaccaggtcctccgaggtcctgtcctcgtattccgtagtgagtcgcacgtccgaggccgacgggtaccacggtacggacctaccgtacccgacgtaccgtacgttcgacggtcggaccgtgggtcgggtcgtagggactagtcctcgtacctacgtaccactaccgccgtacgtacgtacctaggaccgtaccgtaagtacgttaccgtttcgggttaacgttttacgtaccgtacgtaaacccaacgtaacccgtaccgtaaccgttccggtaccttccggttacgtaccggggttaccgttacccggggaacgtaaacgggaaccgtaaggtaacgtaaacgtacggaaaccttacggtcggtacggtcctaggtactacctcgtcttcgttaccctacgtacctttcccggtccgtaacttaccg

SEQ ID NO: 100682 - DNA, 698 bp, Homo sapiens
  misc_feature: GYAE6OF01B12DO.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccacgccaccctgtctttcgtcccgagggaaagcgccacctctctgcgacggccagtcaagacattaggaactacttagcctggtaaccaacagaacgccgtggccaggcctacccaggctcgctcacgtctagtgatgctactaccgagccgacgggcctacgtcggaccacctcccgagaccgtagggtttcaggtcgacgtagggttcgggtacggtacgggaacgtacggtaactttccgaccttcgtaccaacctacgttcccgacaaccggtccgttaagaccgtacgtaacggtaaacgttcgttttacggtacggttttaacttaccgttagtacctaaaccgtaaccgttaaccgtacgtccggtacctccggttcgtttacgggaccgttccgggaacggaaacggggtaccaagggtacgtaaacgttccgaaaacggtaccgtggtcggtaccgagtaccctacgtagtttcctacgttaccttactaccgtccccgtttacccggaccttaacg

SEQ ID NO: 100683 - DNA, 564 bp, Homo sapiens
  misc_feature: GYAE6OF01DHR5N.23.37.D04.1.454.CMB.1.raw
  modified_base (386)..(386): a, c, t, g, unknown or other
  misc_feature (386)..(386): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagacccaccggagaaattgtgttgacacagtctccagccaccctgtctttcgtccccaggggaagagcccaccctctctgcaggccagtcaagacatagaactacttagcctggtaccaacagaagcctggccaggcctcccgaggctgctcatctatgatgcatccagccaggggcccacgtggcactccccgagccgacggttcaggtcggcgtaggtgggtctgggacaggaccttcgactccncaccgtctcccgcacgtaccagacgcgtagaatcgttagtcgtttatactctacaactacgtaccaacgtcgtccgtcgttcgtacggacgttcggacgtacgggacgaggtgaaactcgaaacgcgtgtacggtctgacctcacgtctacgttccttacacttccctcccgtctacg

SEQ ID NO: 100684 - DNA, 759 bp, Homo sapiens
  misc_feature: GYAE6OF01CK3DE.23.37.D04.1.454.CMB.1.raw
  modified_base (229)..(229): a, c, t, g, unknown or other
  misc_feature (229)..(229): n is a, c, g, or t
  modified_base (342)..(342): a, c, t, g, unknown or other
  misc_feature (342)..(342): n is a, c, g, or t
  modified_base (414)..(414): a, c, t, g, unknown or other
  misc_feature (414)..(414): n is a, c, g, or t
tcagacgcgagtatcacgaccggtgctcgatttagtagcatactgttgggtttgggggaggaactgctcagttaggacccagagggaaccatggaacgccccagctcagcttctcttcctctgctactctggcctccagacgacctacggagtaaattgtgttcgacacgagtcctaccacgccctaccttgttccgtttcgacccgaaggggaaacacgcccaccttntcgtgacgacggcctagtacaagactaagttacggaactacgtaacgtcctagaaccaagtacgacgccgtggacctaggcctaccgaggctcgactctaatcgaatcgtacncgactacgtcgaaccggcgtaacgggcctaacgttcggacctaacgttcccgaacggacggtacgtttacgnggtacccggtacttaagggtcggggtacctaggggtaacctacgggtaccctttacacccgtttcgtaaccccacggtaaacctcccgggaactaccgtaccgtaacgtaccgtaccgttaacggtaacgttacgttacggttacgttaacttacgtaacgtaacgtaaccgtacctaacgtaccgacgttccgtacgttaccggtagtaccgttaccggaacgtaacgaaggtaacgtaagtaaaccgtacgtaaaccgtacggtacgtacggtaccgtagaccctacgtaccgttacgttaccgtccgtttaacctaacgttccttaaccccgtgttaacccg

SEQ ID NO: 100685 - DNA, 917 bp, Homo sapiens
  misc_feature: GYAE6OF01CDS7X.23.37.D04.1.454.CMB.1.raw
tcagacgcgagtatcacgaccggtgctcgatttagtagcatactgttggggtttgggggaggaactgctcagttaggacccagagggaaccatggaagccccagctcagcttctcttcctcctgctactctggcctccagacgaccaaccggagtaattgtgttgacacagtcctccagcccaccgttgttcctttcgaccccgaggggaaacacgccctacccttctccttgccgacgggccagtacaaagactaacgtaggtaacttacgttacgccttacggtaccaacaggtaacgccgtcggacccacggccctcccgaggccttcgcctcgactctagtgactgccacttacccgacgaccggaccggtacccgtacggtcggtacctaccgtaccccgtaaccggtcccggtaacggtttcgaacggggttcggaaccggttggggttccggggttacggtaccggggaacgtacggttccctttaccggtaacccgtttcctaaccgtaaccccttcggacccccgtccggtaccgtacccggtaacgaccggttaccgttaacggttaacggtttacggttttaacggtttaaccggtttttaacgtttaccgtttaaccggttaaccgttaaaacccgttaaaccccggttaaccggtttaacccgttaccgggttaccccgttttcccggtttaccgggtttacccgggttaacccgggtttacccgggaacccgggttaaaccgggttaaccgggttaaacgggtaacggttaaacgtaaccgaaaaccggttaccggttaaggtacccgggtaaccgtaccggtaacccgtaccgttaccgtttacccggttaccgttttaccttacccggttaccctttaccccgttcccgtccccgttaacg

SEQ ID NO: 100686 - DNA, 841 bp, Homo sapiens
  misc_feature: GYAE6OF01EW0GP.23.37.D04.1.454.CMB.1.raw
  modified_base (598)..(598): a, c, t, g, unknown or other
  misc_feature (598)..(598): n is a, c, g, or t
  modified_base (835)..(835): a, c, t, g, unknown or other
  misc_feature (835)..(835): n is a, c, g, or t
tcagacgcgagtatcacgaccggtgctcgatttagtagcatactggttgggtttgggggagaactgctcagttaggacccagagggaaccatggaacgccccagctcagcttctcttcctcctgtctactctcggcctccgagacgaccgacggaagtaagttgtgttagactactagtcctaccacgtccctacccgttgtttaccgtttccggaccccggaaggggtaaacgaccgtaccctacccgtttcgttaccgttcggaccggtacgggtaccctaaggtaaccgtaaacggtacttaaacggtttaacggtaaaacctttaccggttaacggtacccgttaacggtaaacccaaggaacggtaaccgtcccgaaggggcccaaccggtccgtcccgacgtcttccgactactattactacggtatacgtccgtacctaacgtacccgacggggacggtaacccggtccgtaccggttaggaccctaccccgtaccgaaaccgttccgggtaacggttcgtacggggtcggtacgtcgggtacgggttaccggacgggtactaaacggttcctactacccgactttaaccnccgaaccgtaccggtaccacggtccgtaaaccgtcgtaacgttacgtaacggttcgtttaacgggtttactttacgttacggtctaaaccgaccttaaccgtaccgtacgtccggttacctcgggttcgtaaccgtacgaccgtacggtaaacggtcgtaacggaacgtaaccgtaagtacctacggtaggaccgtctcggacctacttcgtcgttagtcctaacttccgttccctncccgta

SEQ ID NO: 100687 - DNA, 641 bp, Homo sapiens
  misc_feature: GYAE6OF01BB7GL.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaacgcctggccaggcctcccgaggctgctcatctatgatgcatccagcgacgggccacgtcggcactcccgagccgaggttccaggtcggcgtagggtcggggtcgtggggacaggtactttacacctctccacccacgttcccgacacggtccctaggaccgtaccgtaggaacgttacgttttcggtacggtttttacttaccgtcgttaaccaaacctaaccgtacccaacgttccggtaccgttccggttcgttacgggtaccgttaccgggacccgaaacgggtaccgtaagggtacgtaaacttccgaaaacggtactgggtacgtcgtagaccactacttcgtcgttcttacacttccctcccgtctacg

SEQ ID NO: 100688 - DNA, 585 bp, Homo sapiens
  misc_feature: GYAE6OF01D8UPE.23.37.D04.1.454.CMB.1.raw
  modified_base (529)..(529): a, c, t, g, unknown or other
  misc_feature (529)..(529): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtcccccaggggaaagagccaccctctcttgcgagggccagtcaagacattaggaactacttagcctaggtaccaacagaagcctggccaggcctcccgaggctgctacatcgtatgagtgccactcccgagccgacgggacccacgtgactacgtcccagccgtaagtcaggtggcgaggtggtcgaggacgacgtacttcactcgtacacctactaccgactacgccgtaagaccgtaccgtaaggtaacgttacgtttgtacgttttactactacggtaaccaaacgactaccacgtccgtccgtcgtacgtcgtacgtcggacgaacggacaagganaactacgaaacgtgtagcgtcacgcactgtacttcgtctacacttccctccgctac

SEQ ID NO: 100689 - DNA, 741 bp, Homo sapiens
  misc_feature: GYAE6OF01A530G.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtaccccaggggaaagagccaccctctcttgcagggccagtcaagacattaggaactacgttagcctggtaccaacagaacgcctggccaggctcccgaggctgctcatctatgatgcactccgaggcgacgggccacgtcggcactcccgagccgtaggtccgaggtcggcgtagggtcggggtacgtggggaacctacgtaccgttacaccttcccgtacctaacccgtacgttcccggaccgtacggtacccgtaaaggtccgtaccccgttaaggtttaaaccgtttaccgtttttttacgggtttaactttaacccggttacgttaacccgtaaaaccgtaacccgttaaccctaaccggttccggtaccccgtttaccggttccggtttaccgggtacccggtttaccgggaacccgtaaacggggtacccgttaaagggtaacggtaaactaaccgaaaaccggttagtaccgggtacggtcctacggccctaactcgtttcgtcgttaccttaccgtaccttccgttacccccagttcgttaccg

SEQ ID NO: 100690 - DNA, 797 bp, Homo sapiens
  misc_feature: GYAE6OF01AMNIW.23.37.D04.1.454.CMB.1.raw
tcagacgcgagtatcacgaccggtgctcgatttagtagcatactgttgggtttgggggaggaactgctcagttaggacccagagggaaccatggaagccccaagctcagcttctcttcctcctgctactctggctcccagagaccaccggagaaattgtgttgacacagtctccagccaccctggtctttgtccccaggggaaagacgcccaccctctcttgcagggccagtcaagactattaggaactactagcctggtaccaacagaacgcctggccaggcctcccgaggctgcctcatcctagtgactgcactccgagcgacgggccacgtggaccacgcccgacgccgtacggttcgacggtcggacgtaggtcgggtcgtacgggaactacgtaccgtttacaccgttaccctaccgtaacccgtacttacccggtacctacgggtacccgtaaggtaccgtacccggttaacggttaaacgtttacccgtttttcgggtaaaccggttttttaaccgtacccgttaacgttaaaccgaaaacccgttaacccggttaaaccccgtacgtttaccgggtaccccgttttaccggttcccggtttaacggggtaacccggtttaccccggggaaccggtaaaccggggtaaccggtaaacgggtaaccggtaaaccgttacggaaaacccggtttacgttcgggtccggtaaccgttcgggaaccctaccggttaagttcccgttaacggttcccttaacggttccctttaccccggtttccccgccttacgg

SEQ ID NO: 100691 - DNA, 757 bp, Homo sapiens
  misc_feature: GYAE6OF01BQ52N.23.37.D04.1.454.CMB.1.raw
  modified_base (211)..(211): a, c, t, g, unknown or other
  misc_feature (211)..(211): n is a, c, g, or t
  modified_base (702)..(702): a, c, t, g, unknown or other
  misc_feature (702)..(702): n is a, c, g, or t
tcagacgcgagtatcacgaccggtgctcgatttagtagcatactgttgggtttgggggaggaactgctcagttaggacccagagggaaccatggaagcccagctcagcttctcttcctcctgctactctcggctcccagacgaccaccggagtaaattgtgttgacacagtctccagcccacccttgttctttcgaccccgaaggggaacncgacccacctctcgtgcgacggccagtacaagactagttaacggaactacgttacgccgtacgtaaccaaagagaacgcgtcggaccgacggtcctcccgaggcctcgtctctacgttctagtgacgtcgacgtactccgagccggacggaccctacggtacgacctactacccgacggtaccgtacggttcaggttcggacgttacgggtcggggttacgacggggtacctacgttaccgttcgtaccgtccttaaccgacccgtacgttacccggaccgttacgaccgtaacggaccgtaccgtaaggttaacgtttacgtttcggttaccggtttttaactaacgttacgtaaccgtaaaccgtaacccgtaactaccgttcgtacccgtttcggttacttcgggtacccgaccgggtacaaacgggtactaagggtaaccgtaacggtaaacgaaaccggtacgtacggtaggtacctaccgtaccnccgttacttccggttctttacccacttacccgttttcccgacccgttcgtaaccg

SEQ ID NO: 100692 - DNA, 902 bp, Homo sapiens
  misc_feature: GYAE6OF01A15JT.23.37.D04.1.454.CMB.1.raw
  modified_base (208)..(208): a, c, t, g, unknown or other
  misc_feature (208)..(208): n is a, c, g, or t
tcagacgcgagtatcacgaccggtgctcgatttagtagcatactgttgggtttgggggaggaactgctcagttaggacccagagggaaccatggaacgccccagctcagcttctcttcctcctgctactctggcctccagacgaccacggagtaattgtgttgacacagtctccacgcctacctgttcttcgacccgaaggggaaacncgcctaccctctcgtggaccgagggccagtacaagactagttaacgaacttacgtacgtcctacggtaaccaacgtaacgaacgccgtaggacccgtaacgggtcctacccggaggtctacggtcctactaagttaccgttaagtacggtaacgtaccggtacctaaccgttacccggaacggtacccggaaccggggtaaccctacgggtacggaacccctaaccggttaccccgtaacggtacccggtaacgggtttaccgaggggttacggaccggttagggttcggggtaaccgtacgggtaaccgtaacgttaccttacccgacctttaccgtaacccgaacccgttacggtaccccgtaacgtaaccggtaacccttaacgggtaaccgttaccgtaaacggtttaaacggtttaccggttttaccgggtttaacgttttaacccgttacgttaaccgttaaccgtaaaaccgtaaaccgttaaccctaacggtaccgttacccggtttccggttaacggttaccgggttacccggtaccgggtaaccgggaaaccgggtaacggttaacgggtaaaccgaaaccttaacgggaaaccgttacgggtacggttacgaccgtacggacctaaacggttcttaccgttcttaacccgtacgttaaccctttaccggtcccacgttaaccg

SEQ ID NO: 100693 - DNA, 741 bp, Homo sapiens
  misc_feature: GYAE6OF01A9PYE.23.37.D04.1.454.CMB.1.raw
  modified_base (207)..(207): a, c, t, g, unknown or other
  misc_feature (207)..(207): n is a, c, g, or t
tcagacgcgagtatcacgaccggtgctcgatttagtagcatactgttgggtttgggggaggaattgctcagttaggacccagagggaccatggaagccccagctcagcttctcttcctcctgctactctggcctcccagagaccaccggagaaattgtgttgacacagtctccagccaccctgttctttcgtccccgaggggaaacncgccaccctctcttgcgacgggccagtacaagactattaggaactacttacgcctaggtaaccaacagaacgcctcggccaggcctcccgaggctgctcatctatgatcgactactaccgaggccggacgggccacgtggaccactcccgacgaccgtaggttcgaggtcgcgtacgggtcgggtacgtagggacgagtaccttcactccgtaccacctacgtcccgacgtaccgtaccgtacggacgtaccgtaaggtaaacgtttcgtttacgggttaccgttttaacttaccgtagtaacccaaaccgtaaccgtacccgtaacgttccggccctttacggtaccggttccgggttaccggtaccgggaccggtaaacgggacccgtaaaggggtaaccgtaaaccgtaacgtaaaaccggtacgttacgggtacggtacccgttacggaaccgttaacccgtatttcccggttaccgttttcccttaacccttaacccggtttccccctttaacccggccgtttaaaccg

SEQ ID NO: 100694 - DNA, 741 bp, Homo sapiens
  misc_feature: GYAE6OF01D6MDY.23.37.D04.1.454.CMB.1.raw
tcagacgcgagtatcacgaccggtgctcgatttagtagcatactgttggggtttgggggaggaactgctcagttaggacccagagggaaccatggaagccccagctcagcttctcttcctcctgctactctggctccagacgaccacggagaaattgtgttgacacagtctaccagccctaccttgttctttcgtaccccgaagggggaaacgacgccctacccttcttcttcggcgacgggccagtacaaagactaagtttaaggaaaccttacgttacgccgttaggtaacccaaacgacggaacgccgtacgggacccacgggtccctacccgagggtcctcgccttacacttcttagtgatcgacctacgtccgacggccggacggcctaacgtcggaccacgtcccgacgccgtaggtacgaggtacggcgttagggtcggtcgtagggactacgtacttcacctcactacctactccggacacgtacccgtagaccgtacgtacggttaacgtttcgtttaggtttacgtttaactttacgtacgtaaacctaaacgtaaccttaaccgtaccggttcgtcccgtttcgtccggtttaacgggtccggttaccggaacggtaaccgggaaccggtaaggttaaccggtaaataacccggaaacggtcgtacgggtacgccgttacggaccttacgtcttacgtcgtttacctctaccgttccctacctgtaaccg

SEQ ID NO: 100695 - DNA, 641 bp, Homo sapiens
  misc_feature: GYAE6OF01CQT9E.23.37.D04.1.454.CMB.1.raw
  modified_base (612)..(612): a, c, t, g, unknown or other
  misc_feature (612)..(612): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccgaaggggaaagacgccaccctctcgttgcgagggccagtacaagactattaaggaacttaacttagcctaggtaaccaacagaacgccgtggaccgaggcctcccgaggtctcgacctcattcgtatggatcgcatccagacgacgggccacgtggcacgtccgagccgtaaggttcagtggacgaggttcgggtcgtagggactacgacttccgacttcaccactctccgacacgacgtacgacgtccgtagaacgttacgtttcgtacgtttacgttactgtaacctaaacgtaacgtaacaacgttcgaccgttcgttcgtacggtacgttaccgggaccgaaacgggtacgtaacggtacgtaaacgtaaccgaaagtaacgtggtacggtcgacgacctcgtacgtccgttntacccttcttactcccgttcccgctaacg

SEQ ID NO: 100696 - DNA, 732 bp, Homo sapiens
  misc_feature: GYAE6OF01AO0RM.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagcattaggaactactagcctggtaccaacagaagcctggcccaggcctcccgaggtcctcgctacgatctatgatgcactccagcgacgggaccacgtcggacacgtccccaagtccgaggtttcgaggttcggacgtagggttcgggtaccgtaggggaacctaggtacctttaccaaccgtccttaacccgacccgttaacgtccccggactaccggtacccgtacggtaccgtacccgttaaggtaaacggtttaccgttttacggtaaccggtttttaattaccgtacggtaaccttaaacccgtaacccgttaacccctaacgttcggtaccccgtttacgttccgtttaacggggtaaccgttccgggtaaccggaacgggtaacgtaagggtaacggtaaactaccggtaaaccgtaacgtcggtacggtccgtagacccgtctaacgttcgttaccgttaccttactacgtttcccctacccggtccttaacg

SEQ ID NO: 100697 - DNA, 811 bp, Homo sapiens
  misc_feature: GYAE6OF01A98X3.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagacccaccggagaaattgtgttgacacagtcctccagcccaccctgttcctttcgtcccccgaaggggaaagacgcccaccctctcttgcgacgggcctagtacaagacctattaacggaactacgttacgccgtaggtaaccaaacgagaacgcccgtcggaccacgggcctcccgaggctcgctcatctatgatcgaccactccgacgaccgacgggaccctacgtcggaccacctccccgacgtccgtacgggttccaggtcggcgttaggggtcgggtacggtacgggacgtacgttaccgttaccaccgttccctacccacccgtccgtacccgacgaccgtaccgtaaccggtaccgtccgttaaacggtaaccggtttaccgttttacgggtttaacccgtttttaggttacccgttaccggtaacccgttaaacccgtaaacccgttaacccgtaacccgtttcccgggtaccccgtttaccggttccgggtttaaccggggtacccgggttaccccggggtaacccggaaaccggggtaccgttaaacggggtaacgtaaaccgtaaaccgtaaaacggtcgttacggtaccggcgttaccgaaccctacgtacttaccgttcgttcccttacctaccgtttcccctaccccgtacttaccg

SEQ ID NO: 100698 - DNA, 854 bp, Homo sapiens
  misc_feature: GYAE6OF01D8M4Y.23.37.D04.1.454.CMB.1.raw
  modified_base (205)..(205): a, c, t, g, unknown or other
  misc_feature (205)..(205): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctccagagaccacggagaattgtgttgacacagtctccagcctaccttgttctttcgtccccgaaggggaanacgcccacccttctcgttcgcgacgggccagtacaacgactaagttaacggaacttacttagccgttaggtaaccaaacgagaacgcccgtaggaccgaacggtcctaccccgaggtcctacgtctaccattctagtacggtactggaccacgtaccgaggccgaacgggccctacgtcgccaccgtaccgcgtaccgtaggttcgaaggtcggacgtacggggttcgggtacgtacggggactaacgttaaccgtcctacccgttacctaccgaaccctacgtccccggtaagaccgttacccgaacggtaccgtacttacgggtaaacgttttaccggttttaacgttttaccggtttaaacgttaccgttaacggttaacccaaaacccgtttaacccgttaacccgaaccggtttcccggtaaccccggtttcccgtttaacggtttacccggggttaaccggttacccgggtaaaccggggtaaaccggttaaaccgggtaaaccgggtaaggttaaacccggtaaaccgtaaaacgtaccggtacgggttaacgacccgttagaccccgttaactaaccggtttcgttacccgttcttaaccccgttacgtttacccccgggttcccctaacggtttaacccg

SEQ ID NO: 100699 - DNA, 692 bp, Homo sapiens
  misc_feature: GYAE6OF01DW8K5.23.37.D04.1.454.CMB.1.raw
  modified_base (206)..(206): a, c, t, g, unknown or other
  misc_feature (206)..(206): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagacgaccaccggagtaaattgtgttgacacagtctccagccacctgtctttcgtccccgaaggggaanacgccctaccctctcttcgcacgggccagtcgaaacgacagttacggaaacctcttacgcctaggtaccaaacagaacgccgtggccaagccctaccgaggctgactacactctaatcgtactcgacctaatcccgagtaccgacgggccacgtcgacnctcccgacgaccgtggttacgacggngtcgtagggtcgggtcgtagggactaacgtcgttacctacgtccttaccgacctacgtacccggagtacgtaccgtacgtacgtcccgtaagtaaccgtttacggtttacgttaccggtttacttacgttagtaacctaaaccgtaaccgtaccgtaacgttccgtccgttccgttagttccggtacggttccgggaaccgtaacgggaacccgtaagggtaacgtaacgtaccggaaacgtcgtacggttcgacgtacaccctacacgtcttacgtcttctaccttccctcccgctaccg

SEQ ID NO: 100700 - DNA, 724 bp, Homo sapiens
  misc_feature: GYAE6OF01CZEDY.23.37.D04.1.454.CMB.1.raw
  modified_base (682)..(682): a, c, t, g, unknown or other
  misc_feature (682)..(682): n is a, c, g, or t
  modified_base (719)..(719): a, c, t, g, unknown or other
  misc_feature (719)..(719): n is a, c, g, or t
tcagacgcgagtatcacgaccggtgctcgatttagtagcatactggttgggtttgggggaggaactgctcagttaggacccagagggaaccatggaacgccccagctcagcttctcttcctcctgctactcgtggcctccagagaccaccggataattgtgttagacaacgagtcctaccacgcccacccttgttccttttaccggccccgaaagggggaaacacgcccaccctcttacgttgcgacgggccagtacaacgactaacgttaacggaaccttacgttacgccgttacggtaaccaaacgaacgtaacgccgttaggacccgaaggtcctacccggaggctacgtccactagtcctatacggagtcgacactaccagaccggacgggtccagtccgaactaccgtacccagggtacctaggttacacgggtacggtcgtaacggggttcgggtacgtacgggaacgtacgttaaccttactacggttaccctacccaaccgtacgtacccgagtacgtaaccgtacgacgtaccgtaggtaactacggtttacgtacggtttaatacgtcttaaacgaaccgtaccgtactaacgtcgccgttcgtacggtacggtacgtaccgtacggaacggtacgaagacgaactacgaaacgtcgtacggtgaccggtanacctacgatacgtacgttccacttacgtcctacccgntaacg

SEQ ID NO: 100701 - DNA, 834 bp, Homo sapiens
  misc_feature: GYAE6OF01DRF80.23.37.D04.1.454.CMB.1.raw
  modified_base (208)..(208): a, c, t, g, unknown or other
  misc_feature (208)..(208): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagacgaccaccggagaaattgtgttgacacagtcctccagccaccctgtctttcgtccccgaggggaaacngcccaccctctctgcgagggccagtacaagactaagttaacggaacttacgttacgacctaggtaaccaacgtaacggaacgccgttcggaccacggtccctacccgaggtctcggccttacgattccgtattacggactacggtacctacgtccctaaggccgaaccggggtcccaacggtcggactaaccgttaccccagacccgttaggttaccgagttacggaccggtaggttaccgggtacgttacggacgtaacgggttaccgtttccgacccgttttcgaaccccggtaaccgttaccgaacggtcctaacgggttcccggacgggttaccgacccgttaggttcggttaacggtttaacgttttacggaccgttttacgttttaacgtttccgtacgttcggaaccgttccggtaacgggttcccttacccggaccccgttaccggttacccttaccgggttaccgttaccggggtttcccgggggaacccgggggtaccgtacgggggttaggaacgtttacggaaccggtaacgggttaccggaacccgttgggtcccggtaccgtacgttcccggaacttaacgtttccgttacgttccgttccggttaaccccg

SEQ ID NO: 100702 - DNA, 677 bp, Homo sapiens
  misc_feature: GYAE6OF01DK350.23.37.D04.1.454.CMB.1.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagacccaccggagaaattgtgttgacacagtctccagccaccctgtctttgtccccaaggggaangccaccctctcttgcgacggccagtcaagacaagttagaactactacgccgtgtaccaaacagacgctggccaggcctaccgacgctagctctatctatcgatgcatccagcgaggccagtgacacnccgacgcaggttcaggngctggtggtcgagggactcgactcactctacgccagtccncagccctaggacncgttaagagttcgttacgtcggtttattactacggtaacctaaccgaaccgttaaccctaacggtccgtaccccgtttcggttaccgttacggggtaacccggtttccggggaacccgaaggggttaaaccccggaaacgggggtttacgaaaaaccgttaaccggtaaaacccggtacggtttaccgggacggtaccttaacgggtacccggaaccttacggttacctttgttaaccccgtttactacccgtttaccccttcccgtacccttaacg

SEQ ID NO: 100703 - DNA, 661 bp, Homo sapiens
  misc_feature: GYAE6OF01BYXEB.23.37.D04.1.454.CMB.1.raw
  modified_base (622)..(622): a, c, t, g, unknown or other
  misc_feature (622)..(622): n is a, c, g, or t
  modified_base (657)..(657): a, c, t, g, unknown or other
  misc_feature (657)..(657): n is a, c, g, or t
tcagacgcgagtatcacgaccggtgctcgatttagtagcatactgttggggtttggggggaggaactgctcagttaggacccagagggaaccatggaagccccagctcagcttctcttcctcctgctactctggctcccagagaccaccggagaaattgtgttgactacagtctccagccaccctgtctttcgtccccgaaggggaaagacgccaccctctcgttcgcgacggccagtcaagacattaggaactactacgcctggtaccaacgagaacgccgtggaccgaggcctcccgaggtctgcctacattctagtgatcgcctactccgaggcgacgggcctacgtcggacactcccgagccgtaggtccaggtcggcgtggtcgggtcgtagggacacgtactctacctctacacctaccgtccgactacggcctaggactccgtaggtaacttacgtttcggtacggttttaactcgtagtaaccaaaccgtaccgtactaacggtcgtacccttcggtacgttaccggtacggttacccgaacggtaacgggtaaccctaagggtacgtaaacgaaccgtaaacgtacgtaggtcggacgtacgccgtaaccgtnttaccggtcttccgtacgtaccttcccttacccgnttac

SEQ ID NO: 100704 - DNA, 701 bp, Homo sapiens
  misc_feature: GYAE6OF01CH223.23.37.D04.1.454.CMB.1.raw
  modified_base (307)..(307): a, c, t, g, unknown or other
  misc_feature (307)..(307): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtcttgtccccgaggggaaagcgccaccctctcttgcgacgggccagtcaagactattaggaacttacttagccgtggtaccaacagaagccgtggccacggcctcccgaggctgctcatctatgntcgctatccagcgacgggccacgtcggacacgtcccgacgtccgtaggttcgagggtcggacgtacgggttcggggtccgtaggggacgtacgtaccttcctacctccctaccaccgtactcccggacgacgtacccgtacggaccggtaccgtaggtaaacggttcgttttacggtacgttttacttaccgtacgtaacctaaaccgtaaccgttaacccgtacgtccggttacccgttcggttaccggttacgggtaccggttaccgggaccggtaacgggaaccgtaagggtacggtaaacgtaccgaaacggtacgtcggtacgtccgtacgaaccgtccgttacgttccgttacgttaccttaccgtaccttcccgttacccgcttacg

SEQ ID NO: 100705 - DNA, 901 bp, Homo sapiens
  misc_feature: GYAE6OF01CRVVZ.23.37.D04.1.454.CMB.1.raw
  modified_base (197)..(197): a, c, t, g, unknown or other
  misc_feature (197)..(197): n is a, c, g, or t
tcagacgcgagtatcacgaccggtgctcgatttagtagcatactgttgggtttgggggaggaactgctcagttaggacccagagggaaccatggaagccccagctcaactctctccttcctctctactctcgcgtcccacgagaccgaaccggacgaaattagttgttgtacacacgtctccacgccaccctcgttntttcgtcccgaccgggaaaggaacgccaccctcctcttcgcgaggaccgagtacaacgactagttaagtaaccgtacttacgtaccgtcggtaccgaacaagacgccgtcgaccgacggacgtccccgacggcgtctccgactacgtacttatacgtgagtccgactaccacggaccgggtcggaccggaccttggccgtaacctccccttaaccggccgtaaccgggtttcgtacggtacgggcgtacgggtggggtttcccggaagggtaaccgtagtaaccgtttacccgtaccctaccgtttacccaaaccccgtaccgtttacccggaccctacggtacccgtacgaacggtaccgttacgtaacggtttaaccgttttcggtttaacggttttaaccgtttacctttacgtaaccgttaaaccgtaaacccgttaaccctaaccggtaccggttccccgttacccggtttaccgtttccgggttaaccggttacccgggtaacccgggtaacccggggttaaacgggtaaacccggttaacgggggtaaacttaaacccgggtaaaaccggtaaaaccggttacgggttacgggtaaccgttaccggtaacccgttaaacccggttccttacggtttaccgtttcccgttaccgtttacccgttaaccccgtttccccgtaccttacccggttaaccg

SEQ ID NO: 100706 - DNA, 782 bp, Homo sapiens
  misc_feature: GYAE6OF01B7FQT.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggcctccagacgaccgaccggaagaattgtgttgacacagtctccacgccaccctgttctttcgtaccccgaaggggaaagacgccctaccctctcttgcgacgggccagtacaagactagttaacggaacttacgttacgccgttacggtaaccaacgaaggacgccgtcggccgacggtcctaccgacggtcctcggacctacgtacttacctagtacgtacgtacgacctacgtacccgaaggaccggaccgggacctaccggtacgggcctaaccctcccgacggtccgtaacgggttcgacgggtcggacggttaggggtcggtcggtacgggaacctacgtacctttaccaccgtccgtacccacctaccggacccgtacaccggtaccgtacgacgttaccgtaaggtacgtttacgtttaggttaccgttttaacgtacgtaacgtaaccgaaaccgtaaccgtaccgttacgtcccggtacctttccggtacggttacgggtacccgtaccgggtaaaccggtaacgggtaacggtaaggtaacgtaaaccgtaccggtaaacgtacgtacggtaccgacgtacccgaccgtacgtccgttacgtcccggttcttaccgtacccttcccgttcccgattaccg

SEQ ID NO: 100707 - DNA, 859 bp, Homo sapiens
  misc_feature: GYAE6OF01A7RPW.23.37.D04.1.454.CMB.1.raw
  modified_base (167)..(167): a, c, t, g, unknown or other
  misc_feature (167)..(167): n is a, c, g, or t
  modified_base (426)..(426): a, c, t, g, unknown or other
  misc_feature (426)..(426): n is a, c, g, or t
  modified_base (848)..(848): a, c, t, g, unknown or other
  misc_feature (848)..(848): n is a, c, g, or t
tcagacgcgagtatcacgaccggtgctcgatttagtagcatactgttgggtttgggggaggaactgctcagttaggacccaggagggaaccatggaagccccagctcagcttctcttcctcctgctactctggctccagagaccgacggagtaattgtgttagacanacgtcctaccgacgccctacccgttcgttccgtttccggtacccccggaagggggtaaacgaccgacccctaccccgttccttccgttcgccgtacgggtcctacggttacaaacgtaccgttaatttaaccgggaaccttacgtttacggacccgttacgggtaaacccaaacgtacggaaacggtcccgtacgggaccctaccgggtccctacccgagggccttacggcctaccgtattccgtatagtactcggacncgtaccggacggtcggaccgggaccctacgggtcgaccctaccggtacccctacggtaccggttacggttaccggagggtttacgggaccgggttagggggttacccgggggttaccggacgggggtaacccttacgggttaccccgtttacggttacccgtacctaccccggtaacccgtaccggtaaccccgtacgtacggtacccgtacggtacccgtacggtaaccgttaacggttacggtttacggttaccggtttaacttacgttaccggtaaccctaaaccgtaaccgttaccctacggttcgtacccgtcgttacgtacgggtaccgtacggtaccgacggtacgtaggtaacgaagtacgaacgtagtcgacgtcgtactcgtacgtcctcgtacgttcctactcccgttacncccgtcttagg

SEQ ID NO: 100708 - DNA, 877 bp, Homo sapiens
  misc_feature: GYAE6OF01E5M4T.23.37.D04.1.454.CMB.1.raw
tcagacgcgagtatcacgaccggtgctcgatttagtagcatactgttggggtttggggggaggaactgctcagttaggacccagagggaaccatggaagccccagctcagcttctcttcctcctgctactctggctccagagaccaccggagaaattgtgttgacacagtcctccagcccaccctgttctttcggtaccccgagggggaaacgcgcccaccctcttcgttcgcgacgggccagtacaaagactagttaacggaactacttagcctaggaccaacaagacgcctggaccaggcctcccgaggctacgctacacgtctagtcgtatcgtccacgtaccaaggccggaacggggtcccaacgttcgggacctaccgttccccgaaggtcccgtaacgggttccgtacgggtcggaccgtaggggttacggggttcggtaggggtaaccgtacggttaacccttacctaccgttacctacccgaacccgtaccgtacccgtcgtaaccggcccttaaacggcgttaaccgtaacggtaaaggtttaccgtttacgggttaccgggttttaaacttacccggttacgttaaacccgaaaaccgttaaacccggtaaccgtaaaccgtttccgggtaccccgtttaccggttacgggtttaaccggggtacccggttttaccggggaaacccggaaaccgggggttaaaacccgtaaacggggttaaacggtaaaaacgtaacccgtaaaacgggtaaccgttacggggtaccggttaccggtacccggaacctaacccggtacctttacccggttaccgtttaccctttacccggaaccttttcccccggttaccccggtaccttaaaccgg

SEQ ID NO: 100709 - DNA, 912 bp, Homo sapiens
  misc_feature: GYAE6OF01E4XQS.23.37.D04.1.454.CMB.1.raw
tcagacgcgagtatcacgaccggtgctcgatttagtagcatactgttgggtttgggggaggaactgctcagttaggacccagagggaaccatggaacgccccagctcagcttcttcttcctccgtgtctactcgtcggcctccagacgaccgtaccggaataacgttgttagttacgactacgtacgttcctccgacgacccctaccttggttaccttttccggaccccggtaaagggggaaactaccgaccccttacccttcgtttccgttacggccggtacgggtaccgtaacggttacgaaacggtaccgttaaggtttaaccggtaaacctttacgttaccggtacccgttacggtaaaccaaacggaaccgggtaaccgtccggttacggacccgggtaaccgttcccgtacccggaaaggtccttacggtactacctagtttccgagttacgtaggtccgtctaaccgtccgacgaccgggttccggaacctacgggtccggtactaacccgtaccgaccgttaaccgggttcggttaccggacggtccgggtaggttaccggggtgggttcccggtaaaggggaccttaccggttctacccggtacctttacgtacccgaacggtttccctaccggacgtaccgtacgtaacgtaccgtacgaggttacggttacgttcgtttacggtttacgtaccgttacgtacaaaccgttaccgtaaccgtacgtccggttccgttcggttccgtacgggttacccgtacggtaaccggtaaccggtaacgttacggtaacggtaacctaacggtacgtaccggtagtacgggttctaccggtaacctaccggtacgttccttacgtttacccttaccgttacccgtacctttcccgtactttaacccggg

SEQ ID NO: 100710 - DNA, 1090 bp, Homo sapiens
  misc_feature: GYAE6OF01D861L.23.37.D04.1.454.CMB.1.raw
tcagacgcgagtatcacgaccggtgctcgatttagtagcatactgttgggtttgggggaggaactgctcagttaggacccagagggaaccatggaacgccccagctcagcttctcttcctcctgctactctgctcccagacgaccgacggagtaattgtgttagacactcgtctccgagccctacccgttgttcctttaccggaccccggaaagggggaaacgaccgccctacccctcgttcgttcggccgaaccgggcctaacgtaccgaacgtaacgtaaagtttaacggtaaaccttacgtttaccgtccgtaacgggtaaccaaacggacgtaacgaccgtcggaccgaaccggtccctaccccggaggtcctcgcctacgtacttacgtacgtgtagtccgacgtaccgtacccgaagggacccggtaaccgggtaccctaacggttccggaacccttaccggtacccccggtaacggtaccccggttaacggttacggtaacggggttcggtaaccggtcgggggttacggggtcggtaacggggtaacccttaaacgggttccctttacccgtaccgtttaccccgtaccgtaaacccgtacccgtaccccgggacggtacccccggttaccgttaaaccgggtaacgttaccccgggttaaacgggtttaacccgggttttaaaccgtttttacgggttttaaaccggtttttaccgtttaaacccgttaacggttaaacccctaaaaaccccgggtttaaccccggttaaccggttaacccggttacccggtttacccccgttttacccggggttaaccggggtttttaacccggggacccggggtttttaaacccccggggaaaccgggtaaaacccggggtttaaccggtaaacggggttaaaaccggttaaacccggttaaaccggggttaaaaccttaacgggggtttaccgttaacccgggggttacctaaccccggttacccgttttaaccccgtaaggtttcccgtttaccccgttttaccgttaccccttaccccgggtttaaccccggtttaccccgagtttaaacccccgg

SEQ ID NO: 100711 - DNA, 792 bp, Homo sapiens
  misc_feature: GYAE6OF01D3T0A.23.37.D04.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccacggagaattgtgttgacacagtctccagcccaccctgtctttcgccccgaaggggaanacgcccaccctctcttgcgacgggccagtcaagacattaaggaactactagcctaggtaccaacagacgtcctggccaggcctacccgaggctagctctatctatgatcgactactccgagcgaggtcccagtcggacacgtccccaggtcccgtaggtcgaggtggactagggtcgggtcnggggtaccacggtaccttcaccgttctaccaacccgtctccccggactacgtaccctaggaccgtaccggtaacggtaaacgtttacggtttacggtttaaccgggtttttaactttaaccgttacggttaaaccctaaaaccgttaaccccgttaaacccggttaaaccgtttacccgggttacccccgtttaccccgggtttaccggtttaacggggttaaccccgggttttaacggggaaccccggttaaacggggtaaacccggtaaaggggttaacgggtaaaacgttaaaccggtaaaaacccggttacggttacgggtacggtacgttaacccggtacctaaccgtaacttccgttacggtttcttaacccgtctttaccccgttccccgtcgttaaccc

SEQ ID NO: 100712 - DNA, 712 bp, Homo sapiens
  misc_feature: GYAE6OF01BR829.23.37.D04.1.454.CMB.1.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (704)..(704): a, c, t, g, unknown or other
  misc_feature (704)..(704): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagagaccaccggagaaagttgtgttgacacacgtctccagccaccctgtcctttgtccccgaggggaagacgccaccctctcttgccgacgggccagtcaagactagttaggaactacttagcctgtaccaanagaagccngccaggcctcccgagctgctcactctatgatgcacgtccgagcgacgggaccacgtcggctacgtccccacggccgtaggtttcacggtcgcgtagggtcgggtcgtcgggaacacggtacttccacctccgtaccacctacgtcccgactacggtacctagggacgtcccgtaaggtaacgttactttacggttaccggttttaattaccgttacgttaaccgtaaacccgttaaccggtttaacccgaaccggttccggtacccgtttcccggttaacgtttcggggaaccgggtttacccggacgggtaaacgggtaccgtaagggtacgaaacgtaccgtaaaaccggtcgtacggtcgtacccgttacgaccctacccttagtccgttacgttaccttacctaccgtccctttccccggnttacccgg

SEQ ID NO: 100713 - DNA, 778 bp, Homo sapiens
  misc_feature: GYAE6OF01D4O9H.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaattgtgttgacacagtctccacgccctaccctgttcgtttcgtaccccgaaggggaaagacgccctaccctctcttgcgacgggccagtacaagacctagttaacggaaccttacgttacgcccgttacggtaaacccaaacgaacggaacgcccttacgggacccgaacgggtccctacccgagggtcctcggacttcattctagtgtatcgacactccgagcggacggcctacgtggacctactcccgagccgtaggttacaggtacggacgtaggggtcgggtccgtacggggactaacgtccgttacacccgttcacccgaacctacgtcccgactacgccgttacggacgtaccgtaaggttaacgttacgtttaggtttaccggtttattaccgtacgttaaccgaaaccgtaaccgtaaccgtaccgttacggtaccccttacggttccgtttacgggtaccgggttaccgggaacccggtaaacgggtaacccgtaagggttaaccggtaaaacgtaccgtaaaaccggtacgttacggtacggtaccgttacgaaccttaccgtaccgtttcgttaccgttacgtttacctaccctttcccgtaccccgtacttaacg

SEQ ID NO: 100714 - DNA, 807 bp, Homo sapiens
  misc_feature: GYAE6OF01BQC2U.23.37.D04.1.454.CMB.1.raw
  modified_base (226)..(226): a, c, t, g, unknown or other
  misc_feature (226)..(226): n is a, c, g, or t
tcagacgcgagtatcacgaccggtgctcgatttagtagcatactgttggggtttgggggaggaactgctcagttaggacccagagggaaccatggaacgccccagctcagcttctcttcctctgctactctggctccagacgaccaccggagtaaattgtgttacgactactagtcctccacgccctaccttgttccgtttccggtaccccggaaagggggaaacnccgtacccctacccttcttcgttcgccgacgggtaccaaggtacaaaggactaagttaacggtaaaccttacgttacgaccgtacggtaaccaaagaacgaacggccgtacggaccgaacggcctacccgaggtctacgccttacattactagtaggtactacggtacctacgtaccgaaggtccggaaccgggtacccaacggtcggaaccctaccgtacccgaacggtaccgtacgggttacgacggtacggtacgtagggggtacgggtaccggaggtaacgtacgttacctaccgtactacctaccgtaacctcggtcccgtacgaccgtaccgtaaggaccgtactaaggtaacgttgttacgttacggttaacttacgtactaaccgtaaacctaaccgtaaccgtacggtccgaccccgtttcggtacggttaccgggtaccggtaccggtaaaccggaacggtaacgtaagggtaaccgtaaacgtaaaccgtagtacgtggtacgtacgtacactacgtaccttacgttaaccgttccgttaaactcccgttaccctcccgtacgttaaccg

SEQ ID NO: 100715 - DNA, 830 bp, Homo sapiens
  misc_feature: GYAE6OF01BTXPX.23.37.D04.1.454.CMB.1.raw
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagacgaccgacggagtaattgtgtgacacagtcctccacgccctaccttgttcttccgtacccggaaggggaagaccnccctaccttcttcgtcgcgacggccacgtacgaagactagttaacggaacttacgttcgtaccgtacggtaaccaacgaagacgtccgtacggaccgacggtcctcccggaggtctacgcctactacttactaagtntacgtcgacctacgtaccgacggccggtaccggccctacggtcggaccctaccgtacccggacgtacccggttacggttacgacgggtcggacggttcgggtacggggttaccggtacggtaacgttaccggttaccttacctacccgttaccctaacccgtaacccgtaccgtacccgacgtaaccggttacccgtacggtacccggttaccgtaaggttaaacccgttttcggttttacgggtttaaaccttttaacgttaccgtaaccgtaaaccgtaaaccgttaacccgttaccctaacgggtttcccgttaccccgtttcggtttacgggttaccggtaccggttaccgggaacggtaaacggtacggtaaggtaacgaaccgtaacgaaacggtcgtcggtacgtcgtaaccgtactccgttacgttcgttaccgttccttacgtcccgtttacccgtccgtcttaaccgg

SEQ ID NO: 100716 - DNA, 813 bp, Homo sapiens
  misc_feature: GYAE6OF01ESRB1.23.37.D04.1.454.CMB.1.raw
  modified_base (410)..(410): a, c, t, g, unknown or other
  misc_feature (410)..(410): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagacgaccaccggagaaattgtgttgacacagtctccagccaccctgtctttcgtacccgaggggaaagcgcccaccctctcttcggcacgggccagtcaaagactattaacggaactacttacgccgtaggtaaccaaacgagaacgccgtcggaccacggcctacccgagggtcctcgcttacacttctattagactctccgaactccgaaggtccgacggggtacccacggtcggacctaccgtccccgaggtacccgttaggtaccgnggtcgggacgtaggggtcgggtacgtacgggactacgtacctttacgaccttcccgtaaccgtaacctaccgtccgaccgtacgtaccgtaacggtaccgacgtaacgggttaacgttaacgttttacggttacgttttactttaccgttacgttaaccctaaaccgttaaaccgtacccgttaaccggttcccggtaccgtttccggttaccgttaccggggtacccggttaccgggaacccgggtaaacgggtaaccggtaaacgggttaacggaaaccgtaaacccgtaaaacgttaccggtacggttaccggaacggtccgtaaacccttaacgttaccgttacgtttcccggttaccctttacttacccgtttaaccccgttcccgtacccgttaccg

SEQ ID NO: 100717 - DNA, 739 bp, Homo sapiens
  misc_feature: GYAE6OF01C215S.23.37.D04.1.454.CMB.1.raw
  modified_base (206)..(206): a, c, t, g, unknown or other
  misc_feature (206)..(206): n is a, c, g, or t
  modified_base (728)..(728): a, c, t, g, unknown or other
  misc_feature (728)..(728): n is a, c, g, or t
tcagacgcgagtatcacgaccggtgctcgatttagtagcatactgttgggtttgggggaggaactgctcagttaggacccagagggaaccatggaagccccagctcagcttctcttcctcctgcctactctggctccagacgaccacggagaattgtgtgacacagtctaccagcccaccttgttctttcgacccgaaggggaaanccgccctaccctctcgttcgacgacgggacctagtcaaagactaacgttaacgtaacttaacgttacgaccgtacgtaaccaaacgagtaacgcgtacggccgaaggtcccgaccggtacgtcgtcgtacctacgacttacagtactagtcgactacgccgaacggccggtacggcctaggtacgaacctccgtacccgaacgtaccgtaggttcgacggtggaccgtggggttacggtacggtcgggacacgtacctacgacccttacacctaaccgtcctccgaacgaccgtccgtaaacgccggttagtaagtaacgtttacggtttcttaagggtttacctcgttaacgaaacctaaacccgttacgaacccgtcggtccgttaccccgtttaggtcgttaaggggtcccgtaccgggtaaacggacccggaagttaacgggtaactaaaacgaccggtaaagcggtgtacggctaccgactcttaagtcgttaacgtcctttatcccggttaccccncgtctttaacg

SEQ ID NO: 100718 - DNA, 812 bp, Homo sapiens
  misc_feature: GYAE6OF01BBOLJ.23.37.D04.1.454.CMB.1.raw
  modified_base (134)..(134): a, c, t, g, unknown or other
  misc_feature (134)..(134): n is a, c, g, or t
  modified_base (226)..(226): a, c, t, g, unknown or other
  misc_feature (226)..(226): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (474)..(474): a, c, t, g, unknown or other
  misc_feature (474)..(474): n is a, c, g, or t
tcagacgcgagtatcacgaccggtgctcgatttagtagcatactgttggggtttgggggaggaactgctcagttaggaccccagagggaacccatggaagccccagctcagccttctcttcctcctgctactcnggcctcccagacgacccgaccggagaaattggtacgttgaccacagtcctcacgcccacccttgtccgtttcgtaccccggaaggggaaacncgacccctaccccgtcttccgttggaccgacggggtcccaaggtacaaaacggtaccgtaaagttaacgggaaaccttacgtttacggacccttacgggtaaccccaaacgaggaaccgtccgnggaccccgagggacctcccgacgggntcgacctctaatctagtgactcggcctacaccgacggtaccggagggcccacggtcggccctacgtaccccgacgcccggttaggtccgaggccggtntaccgggtgtaccggtcggatacgtaccttcgaccttccgtacccgtacacccgcccgtacgacgtcccggtagacccgggtaacgtaacggttacgttaacggtttcgttaacggttttaacgttcgtaactaaccgtaaacccgaccgttaaccctcggttccgaccgtttcccggttagttaccggtaccgtaccgggtaccgaacgggaaccggtaggaaccgggaaaccttaacggtaaaccggttacgcgggtaccggtcgtaccgaccgtaccgttaccgttaattcccggtttacttacccgaaccgtttccccgtcccggtccttaccg

SEQ ID NO: 100719 - DNA, 794 bp, Homo sapiens
  misc_feature: GYAE6OF01DJ8XX.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgcctactctcggctcccagacgaccaccggagaaattgtgttgacacagtctccagccaccctgtctttcgtccccgaaggggaaacgacgcccaccctctcgttcgcgacgggcccagtacgaaagactaagttaacggaaccttacttacgcccgtaggtaacccaaacgaaggaacgcccgtaggacccgaacggtccctaacccgagggtccctagccttacgaattcctaagtcggtatacgaccacgtccgtagacccggaagggcccacggtcgacctaccaccccgtagaccccgtagggtttccgaagggtccggtacggacggggtttcgggtaccggtagggggaacccttaacggacctttcccgaacttcccgacccgttaaaccgacccggttccgaccgtaaccggtaccgtaacggtacctaccggtaacgtaacgttaccgtttacggttacggttttaactacgtacgttaacccgaaaccgtaaccgtaacccgtcgttaccggtaccctccgttacggtcgggttaacccggtaccggaaccgtaacgggtaccgtaagggaaggaaaccgttaaccgaaaggaacccgttggacgggtctaacggacctactactcgtacgttccttactccgtaccgttcccagttaccg

SEQ ID NO: 100720 - DNA, 798 bp, Homo sapiens
  misc_feature: GYAE6OF01AQJXZ.23.37.D04.1.454.CMB.1.raw
  modified_base (211)..(211): a, c, t, g, unknown or other
  misc_feature (211)..(211): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctccagagaccaccggagaaattgtgttgacacagtcctccagccctacctgttccttcgtaccccgaaggggaaacncgccctaccctctctcggccgacgggccagtacaacgactaagttaacggaactacgttacgtaccgtacggaaccaacgagaaccgtccgtacggaccgtacggtcctacccgaggtcctacgtcctcgtaactcgttacgtagtactcgacctacgtccgacggacgtaccgggccaacggtcggacctacccgtacccgacggtaccgtacggtaccgtaggtcgacggtacgggttcgggtaacggtacggacgtacgtaccttccactcgtaccaacgtccgaccgacgtacgtacctaacggcgtacccgttagtaaccggtttacgttacgggttacttttaacgtaccgttacggtaaacctaaacccgtaaccgtacccgtacggttcccgtacccgttacggttaccggtacgggttacccggtaccggtaaaccggtaaccgggtaacgtaaacgggtacgtaaacgtaaccgggtaaacgttaacggcgggttacgtacccgtacggaaccgtaacgttccttacggtttaccttaccgttacctaccgtttaacccctcccggtaattaaccgg

SEQ ID NO: 100721 - DNA, 1016 bp, Homo sapiens
  misc_feature: GYAE6OF01EZ368.23.37.D04.1.454.CMB.1.raw
tcagacgcgagtatcacgaccggtgctcgatttagtagcatactgttgggttggggaggaactgctcagttaggacccagagggaaccatgaagcccagctcagctctcttcctcctgctactcgtggctccctaggacgaccaccggagtaaacgttgtgttcggactacgacgttcttacccaagcctacccgttggtcctttacggtcccccgagggggaaaacgtacggtcccgtaaccctggttaccgttcggccgtaaccggggccaggttaccgtaaacgacgtaacgtttacgggaaaccttaccgtttaacgggacccttagggttaaccaaacgtaacgttaaacggccgttacggacccgtaaggtcccgttaacccgaacgggttaccgttccgggaccgttaccggtaaacttacccgttaaaggttacgtcgggttaacggccgttaacttacccggaacgttacggaaaccgggtccctaggtacgggacttaaccgttccgtaacgtaccgtaaggtcggtaacggtcggaccgtaagggttacggggtccgttaggggtaacccgttaaaggtacccgtttactaacccgtcccttaacggacctaaccggttacacccgtaaggtaccctaacggtcgtacccgttaaggtaaccgtaacgtttcgggtacccgttttaagttaccgtttaacgaaccgtaaaacccgtaccgtaaaccccgtaacggtttcccgtaacccgggtttaccgttaaacccgggttaccgggttaaccccgggttaacccgggtaacccggtaaaacgggggttaaccccgttaaaggggtaacccggttaaaaccggttacccggtaaaacggttaaacccgggaacgggttttaacccgttacgggggaacccttacccggtaccggtttaaaaccgtcccggtttaaccctttaccgggttaacctacccgttttaaccggtttccccggaaaccccggttttaacg

SEQ ID NO: 100722 - DNA, 847 bp, Homo sapiens
  misc_feature: GYAE6OF01BNJ0J.23.37.D04.1.454.CMB.1.raw
  modified_base (234)..(234): a, c, t, g, unknown or other
  misc_feature (234)..(234): n is a, c, g, or t
  modified_base (836)..(836): a, c, t, g, unknown or other
  misc_feature (836)..(836): n is a, c, g, or t
tcagacgcgagtatcacgaccggtgctcgatttagtagcatactgttggggtttgggggaggaactgctcagttaggacccagagggaaccatggaacgcccagctcagcttctcttcctctgctactctcggcctccagacgaccgaccggaagtaatttgtgttagaaccacgtacggtctaccgacgtccctacccgttgttaccttttccggaccccggaaggggaaacncgccctaccgttcttcgttggaccggtacggacctagtaccgaaacgacttaaaggttaacggaaacttacgttacggccgttaacggtaaaccaacgtaacggaacgtccgtacgggaccgacggtccttaccggaggtcttcggacctcgtattaccgttagtagtactacaccttacgtacccggacggtacccggccggtaaccctgggtccgacctaacccggtcccgaacggttaccgtacgggttaccacggggtggtaacccggtggggtttaccggggtcgtaacggggtaactaccggttacttacccaccgtttaccgaccaaccgtccgtcgaccgaaccggtcgtacgaccgtacgttacggtaacgtttacggtttcgttacctttacgtccgtaacgttaaccaaaccgtacgtaacctcggttacgtcccttacgggttgtaacccgggtacggtacccggtaacgggtaaaccggtagggttaacgtacaaacccgggtaactaacgggttaccgtaggtccgacgtttagacccttaaggtacctttacgttcgtaaaccctttccgttaccgttccccgttanacccgttacgg

SEQ ID NO: 100723 - DNA, 754 bp, Homo sapiens
  misc_feature: GYAE6OF02I5BJ3.23.37.D04.1.454.CMB.1.raw
  modified_base (276)..(276): a, c, t, g, unknown or other
  misc_feature (276)..(276): n is a, c, g, or t
tcagacgcgagtatcacgaccggtgctcgatttagtagcatactgttgggtttgggggtagggaacgtgctcagttaggacccagagggaaccatggaagcccagctcagcttctcttcctcctgctactctggctcccagagaccaccggagaaattgtgttgacacagtctccagccaccctgtcttgtcccagggaaagagccaccctctcttgcaggccagtcaagccaattaggaacttacgttaagcctaggtacccaacgacgaaagcnggtaccgaccgaggtcccaccggagctacgcgtacagtcctactagtactagctaactccgaagacgacgggacctacgtagggaccaacgtcccgacgaccgtacggttacgacggtacggtaccaagggttcgggtacgtaggggacgtaacggtacggttaccaacggttccttaccgaacccgttacgtacccgaaccgtaacgtacccgtaaggaaccggtacccgttaagggaaaccgttaccgtttacgggtaaccgggttttaaactttaccggtacggtttaacctaaaccgttaaaccgtaacctaaacggtaccggtacccgtacccgttacggttaccggtaccgttaccggtaaccgggtaaccggtaaccggtaaacggtaacgggaaacgtaaccggtaacgtaacggttaagtacggtacgtacgtacgtacgtacgtacgtacgtacttacgtacgtaccg

SEQ ID NO: 100724 - DNA, 185 bp, Homo sapiens; identical to SEQ ID NO: 100579
  misc_feature: GYAE6OF02HSO5C.23.37.D04.1.454.CMB.1.raw
  modified_base (183)..(185): a, c, t, g, unknown or other
  misc_feature (183)..(185): n is a, c, g, or t

SEQ ID NO: 100725 - DNA, 184 bp, Homo sapiens
  misc_feature: GYAE6OF02HCS6D.23.37.D04.1.454.CMB.1.raw
  modified_base (182)..(184): a, c, t, g, unknown or other
  misc_feature (182)..(184): n is a, c, g, or t
tcagacgcgagtatcacgaccggtgctcgatttagtagcatactgttgggtttggggaagaggaagactgacggtcctcccaggagttcaggtgctgggcaccttgggcacagcggccctgggctgcctggtcaaggactacttccatactcgcgtctgagcgggctggcaaggcgcatagnnn

SEQ ID NO: 100726 - DNA, 522 bp, Homo sapiens
  misc_feature: GYAE6OF02HHD25.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcactcccagccaggttcagtggcaggtgggtctgggacagacttcactctcaccatccgcacgcctagacgcctagaagtactttgcggtttattactgtacaacaacgtaccaactcgcctcgtcttggacgttcgccaagggaccaaggtgaaatacaacgactgtggctgcactatctgtcttcactcctcccgctac

SEQ ID NO: 100727 - DNA, 568 bp, Homo sapiens
  misc_feature: GYAE6OF02HHGWL.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatcccgcagccctagacgccctagaagtactttgacggttttaattacgtggttaccaaactaacgtaccaaactcggcccttccgtcttcgggaccgtttcgggaccgaacggggacctaaagggtaggaaaactacgaaaaccgtactcggtaggctgacaacctatcgtgtccttcacttccttcccgcctac

SEQ ID NO: 100728 - DNA, 610 bp, Homo sapiens
  misc_feature: GYAE6OF02JB7QF.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatcccgcagccctagacgcctgaacgtacttttggacggttttaattacttgttaccaaactaaccgttaacccaacttcggcccttccgttcgttcgggaccgtttcggacccgtaaacggggtaccaaagggtcggaaaacttccgaaaaccggtactaggtacggcttacggacctaacctattaccgttaggtttaactttccgaactttcccgtttacccccggaccttaacg

SEQ ID NO: 100729 - DNA, 554 bp, Homo sapiens
  misc_feature: GYAE6OF02HEE13.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatccgcacgcctagacgccctagaacgtactttggcggttttattacgtgttacaactaacgtaccaactcggacccttccgtcttggaccgtttcggaccgtaagggaccaaggtcggaaactcgaaacgactggtacggctcggacacctatcgttcgtcttcgacttccttcccgctac

SEQ ID NO: 100730 - DNA, 526 bp, Homo sapiens
  misc_feature: GYAE6OF02ICXNE.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaaactacttagcctggtaccaacagaagcctggccaggctccaggctgctcatctatgatgcatccagcagggccactggcatcccagccaggttcagtggcagtgggctgggacagacttcactctcacatccgcagcctagacgcctagagtactttgcgtttattactgtcaacaacgtaccaatcggcctccgtcttggacgttcggaccaagggaccaaagggtcggaaactacaaacgactaggtggctgacaccatctgtcttacactcttcccgctac

SEQ ID NO: 100731 - DNA, 516 bp, Homo sapiens
  misc_feature: GYAE6OF02ILTBR.23.37.D04.1.454.CMB.1.raw
  modified_base (385)..(385): a, c, t, g, unknown or other
  misc_feature (385)..(385): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatccgcagcctagngcctgaagtactttgcggtttattactgtcaacaacgtaccaactggcctcgtcttggacgtttcgccaaggaccaaggtgaaatcgaaacgactgtggctgcaccatctcgtcttcatccttcccgctac

SEQ ID NO: 100732 - DNA, 501 bp, Homo sapiens
  misc_feature: GYAE6OF02HZ32M.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcagtgggctgggacagacttcactctcacgatcagcagtgtcgacctgacgattttgctagtttattactgtcagcaacgtggcgcctggcctatccacttcgccaagggactcgactggagagtaggaaacgaactggtggctgcaccatctgtcttctac

SEQ ID NO: 100733 - DNA, 527 bp, Homo sapiens
  misc_feature: GYAE6OF02HJ7LF.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctggggacagacttcactctcacccatccgcagcctagagccctgaagtactttggcggttttattactgtacaacaacgtaccaactggccttccgtcttggacgttcggccaagggaccaagggtgaaatcgaaacgactgtaggctgcacatctgtcttcactccttcccgctac

SEQ ID NO: 100734 - DNA, 523 bp, Homo sapiens
  misc_feature: GYAE6OF02HIGAI.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatcccgcagcctagagcctgaagtactttgcggttttattactgtacaacaacgtaccaactgcctcgtcgttggacgttcggccgaagggaccaagggtgaaatcaaacgactgtacggctgcaccatctgtcttcatccttcccgctac

SEQ ID NO: 100735 - DNA, 522 bp, Homo sapiens
  misc_feature: GYAE6OF02IXFHS.23.37.D04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagcattaggaactacttagcctggtaacccaanagaancctggccaggcctccaggctgctcatctatgatgcatccagcagggccatggcatcccagccaggttcagtgcagtggtctgggacaggtacttcactctaccaccgatccgcagcctagcgcctgaagtactttgcgtttattactgtacaacaacgtaccaatcggacctcgtctggacgtcgctaacggactagtgaatacaacgacgtgtacggctagcaaccatcctgtctctactcctcccgacctacg

SEQ ID NO: 100736 - DNA, 580 bp, Homo sapiens
  misc_feature: GYAE6OF02HUOCB.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcagtggtctgggacagacttcactctcaccatccgcagcctagacgcctagaacgtacttttggcggttttaacttactggttacctaaaccgaaccgttaacccaacgtcggtacccttccgtccgttcggtaccggttacggtcccgaacgggtaaccgaacggtaggaaagtacaaacgtaacgtacgtaggctcgaccaccacgtctcgttcttctacttccttcccgtcccgtac

SEQ ID NO: 100737 - DNA, 648 bp, Homo sapiens
  misc_feature: GYAE6OF02I47ZI.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccggagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaagcctggccaggcctccaggctgctcatctatgatgcatccagcagggccactggcatcccagccaggttcagtcggcaggtggtctgggacaggacttcactctcacctatccgcacgtccctaaggacgcctaggaacgtacttttggacggttttaattacctaggttccaaacgtaaaccgttacccaaacgttccgggtcccttacccgttcgtttacgggaaccgtttccgggaacccgtaaaggggaacccgtaaaggggttacggaaaacttaccgaaaaccggtaaccgttggttacgggaccgttggtaccccgtaacctagttcctttacgttacctttacgacctttcccgttccccggtacctacgttcc

SEQ ID NO: 100738 - DNA, 541 bp, Homo sapiens
  misc_feature: GYAE6OF02HO72L.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatcccgcagccctagacgcctgaacgtactttgcggttttatactgtacaacaacgtaccaactggaccctcgtcttggaccgttcggaccgaggggaccaggggtagaaaacgtcgaaacgacgtggtacggctgcaccgtatctgtcttcacttccttcccgctacg

SEQ ID NO: 100739 - DNA, 593 bp, Homo sapiens
  misc_feature: GYAE6OF02GQBRF.23.37.D04.1.454.CMB.1.raw
  modified_base (373)..(373): a, c, t, g, unknown or other
  misc_feature (373)..(373): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtctttgtccccaggggaaagagccaccctctcttgcagggccagtcaagacattaggaactacttagcctggtaccaacagaagcctggccaggctcccaggctgctcatctatgatgcatccagcaggccatggcatccagccaggttcagtgcaggtggtctgggacagacttcactctcaccatccgnagcctagacgcctgaacgtactttggcgtttaattacgtagtaccaaactaacgtacccaacgtcggacccttaccgttcgttacgggaccgtttccgggacccgtaaaggggaccgtaaagggtagggaaaactaccgaaacgtacgttcggtgggaccttcggacctaaccgtacgttcttacggttccctttacagttccctttcccggacctaacg

SEQ ID NO: 100740 - DNA, 539 bp, Homo sapiens
  misc_feature: GYAE6OF02I6VRO.23.37.D04.1.454.CMB.1.raw
  modified_base (526)..(526): a, c, t, g, unknown or other
  misc_feature (526)..(526): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagcattaggaactacttagcctggtaccaacagaagcctggccaggctcccaggctgctcatctatgatgcatccagcagggccactggcatcccagccaggttcagtgcagtgggtctgggacagacttcactctcaccatccgcacgcctagacgcctgaagtactttgcgtttattacctgttacaactaacgtaccaacgtcggcccttcgtcttggtaccgttcggaccgtaacgggacctaagggtacggaaactcaaacgactgtacggctgcaccatctcgtcttacntccttcccgctac

SEQ ID NO: 100741 - DNA, 539 bp, Homo sapiens
  misc_feature: GYAE6OF02IMBKJ.23.37.D04.1.454.CMB.1.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacngacttcactctcaccatccgcagccctagacgcctgaagtactttgcggttttattactgtacaacacgtaccacgtcggcctcgtcttggtacgttcggaccgaagggaccaagggtacggaaactacgaaacgacgtggtacggctgaccaccatcgtcgtcttcactccttcccgctac

SEQ ID NO: 100742 - DNA, 529 bp, Homo sapiens
  misc_feature: GYAE6OF02HOMWT.23.37.D04.1.454.CMB.1.raw
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (441)..(441): a, c, t, g, unknown or other
  misc_feature (441)..(441): n is a, c, g, or t
tcagacgcgagtatcacgaccggtgctcgatttagtagcatactgttgggttggggagggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcaggtgggtcngggacagcttcactcncaccatcccgnacgcctagacgcctagaacgtctttgcggtttatactgtacaacacgtaccacgtgcctcgtnttggacgttcggcaagggaccaaggtagaatacgaaacgactggtcggctacgcacctatccttgtccttcgattcccttcccgacta

SEQ ID NO: 100743 - DNA, 538 bp, Homo sapiens
  misc_feature: GYAE6OF02IHZY0.23.37.D04.1.454.CMB.1.raw
  modified_base (262)..(262): a, c, t, g, unknown or other
  misc_feature (262)..(262): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaanagaagcctggccaggctcccaggctgctcatctatgatgcatccagcagggccactggcatcccagccaggttcagtgcagtggtctgggacagacttcactctcaccatccgcagccctagacgcctagaagtactttcgacggttttattactgttacaacaacgttacccaatcggccttccgtcttggaccgtttcggaccgaagggacccaaagggtcgaaatcgaaagactggtgctgcctaacatctacgtcttcactcttcccgctac

SEQ ID NO: 100744 - DNA, 536 bp, Homo sapiens
  misc_feature: GYAE6OF02FKUOO.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctccaggctgctcatctatgatgcatccagcagggccagtggcatcccagccaggttcagtggcagtgggtctgggacagacttcactctcaccatccgcagcctagacgcctgaacgtctttgcggtttatactgtacaacacgtaccaactcggccttccgtcttacgggacgtttcggacccgtaagggaccaaggtacggaaatacgaaacgactaggcggctgacaccatctcgttcttcatccttccgctacg

SEQ ID NO: 100745 - DNA, 662 bp, Homo sapiens
  misc_feature: GYAE6OF02GUHYL.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcaggtgggtctgggacagacttcactctcaccatccgcacgcctagacgccctagaacgtacgttttggccgggttttaattaccgttaggttacctaaacccgtaaaccggttaacccaaaccgttccgggtaccccttacccggttccgtttcggggtaccggtttccgggacccgtaagggggaaccctaaagggtacggaaaacttaccgaaaaccggtacgttcgggtacgggtccttacggaccgtaaccctaacgtttcccgttacggtttccctttacctaaccgtttccccgttttaccccggcccttaacc

SEQ ID NO: 100746 - DNA, 223 bp, Homo sapiens
  misc_feature: GYAE6OF02GV7XY.23.37.D04.1.454.CMB.1.raw
  modified_base (219)..(223): a, c, t, g, unknown or other
  misc_feature (219)..(223): n is a, c, g, or t
tcagacgcgagtatcacgaccggtgctcgatttagtagcatactgttgggtttgggggaagaggaagactgacggtcctcccaggagttcaggtgctgggcaccttgggcacgggggaggtgtgtcacaagatttgggctctgtgcacagcggccctgggctgcctggtcaaggactacttccatactcgcgtctgagcgggctggcaaggcgcatagnnnnn

SEQ ID NO: 100747 - DNA, 542 bp, Homo sapiens
  misc_feature: GYAE6OF02GLVH5.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcagtgggtctgggacagacttcactctcaccatccgcacgcctagacgcctggaaacgtctttgcggtttaatacctggttacaactacgtaccaacgtggcccttcgtcttggacgttcggaccaacgggaccaagggtcgaaaatcgaaacgtactggtaggctgaccaccatccgtgttcttctacttccttcccgcta

SEQ ID NO: 100748 - DNA, 579 bp, Homo sapiens
  misc_feature: GYAE6OF02GNMDH.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcactcccagccaggttcaggtggcaggtgggtctgggacaggacttcactctcaccatcccgcacgcctagacgccgtagaacgtactttggacggttttattacgtagttacaaactaaccgtacctaacgtcggtccctccgttcttgggtaccgttcggaccgaacgggaccaacgggtaggaaactaccgaaacgtacgtgtacggctacgacgacctattcctcgttacttcacttcccgttcccgacctacg

SEQ ID NO: 100749 - DNA, 549 bp, Homo sapiens
  misc_feature: GYAE6OF02JDC31.23.37.D04.1.454.CMB.1.raw
  modified_base (525)..(525): a, c, t, g, unknown or other
  misc_feature (525)..(525): n is a, c, g, or t
  modified_base (546)..(546): a, c, t, g, unknown or other
  misc_feature (546)..(546): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgagtgcatccagcagggccactggcactcccagcccaggttcagtggcaggtgggtctgggacagtacttcacttctcaccatcccgcacgcctagacgcctagaacgtcttttgacggttttattacgtgtacaactaacgtaccaacgtcggccttcgttcttggaccgtttcggaccgtaagggaccaagggtcgaaatacgaaaccgtatggtggctgacactntctcgtcttcacttctcccgntac

SEQ ID NO: 100750 - DNA, 609 bp, Homo sapiens
  misc_feature: GYAE6OF02G3Y7P.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagcccaggttccaggtggcaggtgggtctggggacaggtacttcactctcaccatcccgcagccctagacgcctgaagtctttggcggttttattactgttacaaacgaacgttacccaacgttcggacccttccgttcgttacgggtaccgtttccgggaccgtaaacggggacctaaagggtcgaaaactccgaaaacgtaccgtggtacgggccttacggacctaaccgtagttccttacggttaccttaccgacctttcccgtttccccggacttaacg

SEQ ID NO: 100751 - DNA, 721 bp, Homo sapiens
  misc_feature: GYAE6OF02J33MD.23.37.D04.1.454.CMB.1.raw
  modified_base (209)..(209): a, c, t, g, unknown or other
  misc_feature (209)..(209): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccacggagtaattgtgttgacacacgtctccagccctacccttgtctttcgccccgaaggggaaacncgcccacccttctcttggccgacgggccagtcaagactagttacggactacttacgcctaggtaaccacagacgccgtacggccaggcctcccgaggtcctcgcctacacgttctaagtcgacgttcgaccacgtccgaaggccgacgggtccacggtcggaccacgttacccgacggtaccgttacggttcgacggttcggacgtagggttcgggtcgttacgggactacgtaccttaccactccctaccaccgtacgtcccgacgacgtaccgtacgtaccgtaccgttagtaaaccgtttcgtttaccggtactttaactaccgtagaaccctaaccgttaacgtccctaaggtccgtccttacggttgtaccgggtacgtaccgaaccgtaaagggacccgtaaggtaccgaaactacgaaccgttcggtcgtaccggtaccttgaacccctaccgttagtcccgtttacgttaacccttcgtacctttcccccgtaccgacttaacg

SEQ ID NO: 100752 - DNA, 576 bp, Homo sapiens
  misc_feature: GYAE6OF02IWVOR.23.37.D04.1.454.CMB.1.raw
  modified_base (296)..(296): a, c, t, g, unknown or other
  misc_feature (296)..(296): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtctttgtccccaggggaaagagccaccctctcttgcagggccagtcaagacattaggaactacttagcctggtaccaacagaagcctggccaggctcccaggctgctcatctangatgcatccagcagggccactggcatcccagcctaggttcagtggcaggtgggtctgggacagcttcactctcacccatccgcagaccctagacgcctagaacgtactttggcggttttaattactgtacaactaaccgtaccaactcggtccttcgtcttcgggacgttcggaccgtaagggacctaaagggtcggtaaaatacgaaacgtacgtggtacggtcctagacctaacctagttccgtacgttccttacgacttccccttacccgacctacg

SEQ ID NO: 100753 - DNA, 610 bp, Homo sapiens
  misc_feature: GYAE6OF02I02ZX.23.37.D04.1.454.CMB.1.raw
  modified_base (372)..(372): a, c, t, g, unknown or other
  misc_feature (372)..(372): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtcccccaggggaaagagccaccctctcttgcagggccagtcaagacattaggaactacttagcctggtaccaacagaagcctggccaggctcccaggctgctcatctatgatgcatccagcgagggccactggcactcccagccaggttcagtggcagtgggtctgggacagaccttcactcncaacccgtatcagcacgtcccttcacgccctgaagattgttgacttaatttatttaccttagttactaaaagttataaacacgttcgaccccgttaggaccggttccggaccggtacggggaccgtagggttacggaaacttaccgaaacgaacgttggtacgggtaccgtaggtacccgaaccgttacgtaccgttcgtttacccttacgtaccttttacccgtccccccggtaacc

SEQ ID NO: 100754 - DNA, 567 bp, Homo sapiens
  misc_feature: GYAE6OF02IX8DC.23.37.D04.1.454.CMB.1.raw
  modified_base (542)..(542): a, c, t, g, unknown or other
  misc_feature (542)..(542): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcactcccagcccaggttcaggtggcaggtgggtctgggacagcttcactctcaccactccgcacgcctagacgcctgaagtactttggtcgtttattacgtgttacaactaacgtacctaacgtcggccttccgtcgttcggaccgttcggaccgtaacgggaccgaagggtaggaaactacgtaaacgtacgtaggtcggctcgacgtaacctatccgtnttcttactacttcttacccgctacg

SEQ ID NO: 100755 - DNA, 545 bp, Homo sapiens
  misc_feature: GYAE6OF02IZN8C.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaagcctggccaggctcccaggctgctcatctatgatgcatccagcagggccactggcatcccagccaggttcagtgcagtgggctgggacagacttcactctcaccatccgcacgcctagacgcctagaacgtctttgcggttttattacttgttacaactaaccgtaccaacgtcggccctccgtcttcggacgttcggacctaagggaccgtaaggtcggaaatcgaaacgtacgtgtacggctcgacacctactctcgtcttccatccttcccgctac

SEQ ID NO: 100756 - DNA, 551 bp, Homo sapiens
  misc_feature: GYAE6OF02FXQVN.23.37.D04.1.454.CMB.1.raw
  modified_base (371)..(371): a, c, t, g, unknown or other
  misc_feature (371)..(371): n is a, c, g, or t
  modified_base (547)..(547): a, c, t, g, unknown or other
  misc_feature (547)..(547): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcactcccagccaggttcagtggcaggtgggtctgggacagacttcacttcnccaccactcccgcagcctagacgcctgaagtcctttggacggtttatactgtacaactaaccgtacaacgtcggccttccgtcgttggtacgttccgaccgaagggtaccaaagggtgaaactaccgaaacgtactggtagctgaccaacctagtctcgtctctacttcctcccgntacg

SEQ ID NO: 100757 - DNA, 559 bp, Homo sapiens
  misc_feature: GYAE6OF02HSFSG.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaagcctggccaggcctcccaggctgctcatctatgatgcatccagcagggccagtggcatcccagccaggtcagtgcagtgggtctgggacagacttcactctacaccatccgacacgcctagacgctagaagtactttgcggtttatactgtacaacaacgtacaagtcggaccttcgtcttggaccgttcggaccgaagggaccaagggtacgaaacgtacgaaacgtacgtggtacggctaggctaacctgtccgtcgttccttactaccgttccgttaccccgccttaacg

SEQ ID NO: 100758 - DNA, 564 bp, Homo sapiens
  misc_feature: GYAE6OF02I5E21.23.37.D04.1.454.CMB.1.raw
  modified_base (549)..(549): a, c, t, g, unknown or other
  misc_feature (549)..(549): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgctatccagcagggccacgtggaccactcccagccctaggttcaggtcggcaggcggtctgggacaggacttccactctccaccatccgctacgcctagacgcctagaacgtactttggacggtttatactgtacaactacgtaccaacgtcgacccttcgtcgttggaccgttccggaccgaacgggaccaagggtacgaaacttacgaaacgtctaggtacggtcgtgaccactatctagttcctanatcccttccgctaac

SEQ ID NO: 100759 - DNA, 581 bp, Homo sapiens
  misc_feature: GYAE6OF02H2B48.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccatggcatcccagccaggttcagtgcagtggtctgggacagacttcactctcaccactccgcacgccctaagacgcctgaacgtacgtttgtacggttttacttacttgtacaacaaccgttaaccaacgtcggacctccgtcgttcggaccgtttcggaccgtaagggaaccgtaaggtcggaaaatcaaaccggtacgtggtacggcgttacgacctaccctatccttacggttacctttccactttaccctttccccgctaacg

SEQ ID NO: 100760 - DNA, 588 bp, Homo sapiens
  misc_feature: GYAE6OF02GPJAI.23.37.D04.1.454.CMB.1.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccgaggggaaagagcccaccctctcgttgcagggccagtcaagacattaggaactacttagcctggtaccaacagaacgcctggccaggctcccgaggctgctcatctatgatgcanccagcagggccatggcatcccagccaggttcagtggcagtgggtctgggacaggtacttcactctacaccatccgcagacctagacnccgtgaagtcgtttgcggtttatacttgtacaactaacgtaccaacgtcgtacctccgtcttacgggaccgttcggtaccaacggggaccctaaggtacgggtaaaactcgtaaaacggtagtacggtcggaacgtcgaccgtacctacgttcgtacggttccttaccaccgtttccttccccgacctacg

SEQ ID NO: 100761 - DNA, 643 bp, Homo sapiens
  misc_feature: GYAE6OF02H65TG.23.37.D04.1.454.CMB.1.raw
  modified_base (400)..(400): a, c, t, g, unknown or other
  misc_feature (400)..(400): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcgacgggcccacgtggaccactcccgagccctaaggttcaggttcggacgtagggttcgggtacgtggggactaggtacctttcaccttcnccacccatcccgactacgcccgtaaggaccgtcctaggtaaacgttacgtttgggtaccggtttttaattaccgtcgttaaccaaaccgtaaccgttaacccaacgttcggtacccttccggttcgttacgggttaccgttccgggaccgtaacgggacctaaagggtcgaaaactcgaaacgtacgtggtcggctacgcctaacctattccgtgttaccttcacttcccttcccgacttacg

SEQ ID NO: 100762 - DNA, 642 bp, Homo sapiens
  misc_feature: GYAE6OF02HTDHS.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatccgcagccctagacgcctagaagtacttttcggacggttttacttacttcggttaccaaactaaccgttaacccaacgttcgggacccttccggttccgtttacgggaccggttttccgggacccgtaaagggggtaaccctaaaggggtacggaaaagttaccgaaaacggtaacgttgggtacgggccttacggaccctaacccgtaagttcccgttacggttccgttttaccaacgttttccccgtttaccccggacccttaacg

SEQ ID NO: 100763 - DNA, 635 bp, Homo sapiens
  misc_feature: GYAE6OF02I9XCH.23.37.D04.1.454.CMB.1.raw
  modified_base (262)..(262): a, c, t, g, unknown or other
  misc_feature (262)..(262): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaanagaagcctggccaggctcccaggctgctcatctatgatgcatccagcgagggccacgtggcactcccagccaggttcagtggcagtgggtctgggacagacttcactctcaccatccgcacgcctagacgccgtagaacgtacgtttgtacggttttattaccgttgtacctaaacctaaccgtacccaacgtcggtcccttccgttcgttcgggtacccggtttcgggacccgtaacggggaccctaaaggggttacggaaaacttaccgaaaaccgtacgttacgggtacgggtaccttacggacctaacccgtacgttccgtttacggttacctttacctaacgtttcccgtttaccccgcccttaaccg

SEQ ID NO: 100764 - DNA, 784 bp, Homo sapiens
  misc_feature: GYAE6OF02HBYWV.23.37.D04.1.454.CMB.1.raw
tcagacgcgagtatcacgaccggtgctcgatttagtagcatactgttgggtttgggggaggaactgctcagttaggacccagagggaaccatggaagcccagctcagcttctcttcctcctgctactctggctccagagaccgaccggagaacttgtgttgacacagtctcagccaccctcgtctttcgtccccaggggaaacgagccacccgtctcttagcagggccagtcaagacattaaggaactacgttacgcctaggtaccaacgagaacgtccgtaggaccaggcctacccgaaggcctagcctcagttctaatgattgcaagttccgagcgacgggccacgtggcactcccgagtccgaggttcagtcggactaggtgggtacgtacgggaactaggacctttacgaccttcgtaccgacctaacgtcccggacacggtaccgttaacgggacggtcccttagggaaacgttccgttttcgggtaaccgggtttttaacttaccgttacgggttaacctaaaaccgtaacccgttaacccgtaaaccgttaccggggtacccctttaccgttaccgttttacgggaaccggttttacccggggaacccgtaaagggggtaaccctaaacggggtttaacggaaaaacgttaccgttaaaaccggaccgtttacgggttaccgggaccgtttaccggaccgtaacccggtacgtttaccggtacgggtttacctttacccggttaacgttttacccggtttaccccggtaccttacgg

SEQ ID NO: 100765 - DNA, 603 bp, Homo sapiens
  misc_feature: GYAE6OF02HMOWO.23.37.D04.1.454.CMB.1.raw
  modified_base (379)..(379): a, c, t, g, unknown or other
  misc_feature (379)..(379): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcatcccagccaggttcagtgcagtgggtctgggacagacttcactctcaccatcccgnacgcctagacgtcctaggaagtctttgacggttttatactgttaccaaacgtaaccgttaccaacgtcggtacccttccgttcgttacgggaccgtttccgggaccgtaaacggggaccctaaaggggtacggaaaacgttacgaaaaccggtacgttcggtacggtctacgacctaaccgtagtccgttcgttccttacctacttcccgtttccccgcttacg

SEQ ID NO: 100766 - DNA, 627 bp, Homo sapiens
  misc_feature: GYAE6OF02I15EX.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagcccaccctctcttgcagggccagtcaagacagttaggaactacttagcctggtaaccaacagaagcctggccaggcctcccgaggcctgctcatctatgatgcatccagcagggccacgtggcacgtcccagcccgtaggttcaggtggacaggtcgggtctgggacagtacttcacgttcctacgacctactccgcacgacctagacgtccgtagaacgtactttggtacggttttacttacgtcgttacaaactaaccgttaaccaacgtcgtaccttccgttcgttcgggtaccgttaccggaccgtaacgggaccgtaaacgggtacgaaacgttacgaaaccgtacgtagggtacggtacgtcgaccaaccgtacgttaccgttcgttaccttctacgtccctttcccgaccttacg

SEQ ID NO: 100767 - DNA, 591 bp, Homo sapiens
  misc_feature: GYAE6OF02JIC70.23.37.D04.1.454.CMB.1.raw
tcagacgcgagtatcacgaccggtgctcgatttagtagcatactgttgggtttgggggagaaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagtacttcactctcaccatccgcagcctagacgcctagaacgtactttcgtacggttttactacttgtaccaaacctaaccgtaccaaactcggtacccttccgttcttacgggtaccgtttccggaccgaaacggggtaccgtaaagggtacgaaaactacgaaaccgtacgtaggtaggtacctgacctaacctagtccgttcgtccttcacttccgttaccccgccttaacg

SEQ ID NO: 100768 - DNA, 723 bp, Homo sapiens
  misc_feature: GYAE6OF02H5385.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggcctccagagaccaccggagaaattgtgttgacacagtctccagccaccctgtctttcgtccccgaggggaaagacgccaccctctcttgcagggccagtcaagacattaggaactacttagcctggtaccaacagaagcctggccaggcctccaggctgctcatctatgatgcatccagcgacgggccagtcggcatcccaagcgaggttccaggtcggcctaggtgggctggggactaggaactttcacttcgtccaacgatcccgactagcccgtaagacgcctaggaaagtccgttttaggtcgggtttaattttaccggtagttaaacccgaaaccgtaaaaccttaacccgtaaacgtcgggtaccctttccggtaccggtttacgggacccggttttaccgggacccgtaaacggggtaaacccgtaaaaggggttacggtaaaaacgtacccggtaaaaaccgtaaccgtttcgggttcggtaacccgtacggtaaccgaaccccgttaaacgttccggtttaccggttacccttttaaccgtaccggtttttaccccctttacccccggggactttaaccccg

SEQ ID NO: 100769 - DNA, 617 bp, Homo sapiens
  misc_feature: GYAE6OF02JK1ZS.23.37.D04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaanagaagcctggccaggctcccaggctgctnatctangatgcatccagcaggccacgtggcatcccagccaggttcagtgcagtggtctgggacaggacttcgactctacacctatccgacacgtcctaagcgacctagaacgtcgtttggtacggtttactacgtgtacgtaacaaccggtaccaacttcggtacccttccgttcgtttacgggaccgttccgaaccgtaacgggaaccgtaagggttacggtaaaactaccgaaaaccgtacgttacggttcggtaccgttagaccggtacccaagttccgttacgttaccttccgtaacgtcccgtttacccgaccttaacccg

SEQ ID NO: 100770 - DNA, 555 bp, Homo sapiens
  misc_feature: GYAE6OF02GPCMH.23.37.D04.1.454.CMB.1.raw
  modified_base (290)..(290): a, c, t, g, unknown or other
  misc_feature (290)..(290): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggactacttagcctggtaccaacagaagcctggccaggctcccaggctgctnatctatgatgcatccagcagggccactggcatcccagccaggttcaggtggcaggtgggtctggggacagacttcactctcaccatccgcagcctagacgcctaggaacgtacttttggacgttttatgcttgtacaacaacgtaccaactgcctccgtcttggaccgttcggaccgtaagggacctaaggtacggaaactcgaaacgaactcggtaggctacggacaccgtattctggttaccttccacgtttcctcccgtacc

SEQ ID NO: 100771 - DNA, 786 bp, Homo sapiens
  misc_feature: GYAE6OF02JS77I.23.37.D04.1.454.CMB.1.raw
  modified_base (257)..(257): a, c, t, g, unknown or other
  misc_feature (257)..(257): n is a, c, g, or t
tcagacgcgagtatcacgaccggtgctcgatttagtagcatactgttgggtttgggggtagggaacgtgctcagttaggaccagagggaaccatggaagcccagctcagctctcttcctcctgctactctggctccagagaccaccggagaattgtgttgacacagtctccagccaccctgtctttgtccccaggggaacagccaccctctcttgcaggccagtcaagcattaggaactacttagcctggtaccaanagaagcctggccaggctacccgaggctcgactcacgtctagtgacttcgctacgtcccagcgaacgggcccacgttcgggactaccgtaccccgagggtacccctacggggtttacctacggggacggtcccgtaacggggtttcggggtcccgtttaacggggggaacctaaccggggttaaacctttcccgaacgttttccccgtaaccgtaaccccggtaacgtttcccccgggacgaaacccgttcccggttaaaccggaacgtcccggtaagtaaccggttaaccgttttacgggtacggtttttaacgttaacccgttgttaacccgtaaaaccgtacccggtaaacctaaccgttccggacccttttacccggttacggtttaccggtacccggttacccgggaccggtaaaccggggtacctaacgggggtaacgtaacgtacctaaaccggtacgttaggcggtacgaggtaccaacgtacgtcctggttaccttccgaacctttcggacccttaccgtg

SEQ ID NO: 100772 - DNA, 575 bp, Homo sapiens
  misc_feature: GYAE6OF02I1FLM.23.37.D04.1.454.CMB.1.raw
  modified_base (374)..(374): a, c, t, g, unknown or other
  misc_feature (374)..(374): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctccaggctgctcatctatgatgcatccagcagggccactggcactcccagccaggttcagtggcaggtgggtctgggacagacttcactctcaccnctccgcacgcctagacgcctagaacgtactttggcggttttaatactagttacaacgtaaccgtacccaacgtcggtaccttccgttcgttacgggtaccgtttcggaccgtaacgggacctaaagggtacggaaaataccgaaacgacgtgtacggctacgacaacctattcgtcgtcttcacttccgttacccgctacg

SEQ ID NO: 100773 - DNA, 660 bp, Homo sapiens
  misc_feature: GYAE6OF02HJNDD.23.37.D04.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
tcagacgcgagtatcacgaccggtgctcgatttagtagcatactgttgggtttggggggtagggaacgtgctcagttaggacccagagggaaccatggaagtccagctcagcttctcttcctcctgctactctggctccagagaccaccggagaaattgtgttgacacagtctccagccaccctgtctttcgccccaggggaaancgccaccctctctgcacgggccagtcaagacattaggaactacttagcctggtaccaaacagaagcctggaccagggtcctcccgaaggctgctcatctangatgcaatccagcgaggcccagtcggcaactccccagaccctagggttcaaggtcggccgaggttcgggtctggggaactacggtacctttcgaacttccgtaccaaccgtacgtcccgatacgtacccgtagacgccgtagaacgttacgtttcggtacgttttaacttacgtacgtacgtaaaccaaccgttaaccaacgtcgggtacccttcgttcgttacggtaccggttccgaccggaaacgggtaccgtaaacgggtaacggtaaaccttaacgaaaccgtacgtaggtcggacttcggaccaaccgtacgtacgttcgttaccttatacccttccgttccccagtac

SEQ ID NO: 100774 - DNA, 604 bp, Homo sapiens
  misc_feature: GYAE6OF02HB6RO.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtctttcgtccccaggggaaagngccaccctctcttgcaggccagtcaagacattaggaactacttagcctggtaccaacagaagcctggccaggctcccgaggctgctcatctatgatgcatccagcgagggccacgtggcacgtcccagccaggttcaggtggcaggtgggtcgtgggacaggtacttacgacttcctacacctatcccgcacgcctagacgtcctagaacgtactttcggtcggtttaattactgttactaacgaacgtacctaacgtcgtccttccgttgtcggtaccgttcggaccgtaacgggaaccgaaagggttacgaaacgttacgaaacgtacgtggtacggtacgtcggaccaccgtaacgttcgttacgttaccttacgtactccttccccgaccttaccg

SEQ ID NO: 100775 - DNA, 635 bp, Homo sapiens
  misc_feature: GYAE6OF02JBBEQ.23.37.D04.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagacattaggaactacttagcctggtaccaacagaacgcctggccaggctcccgaggctgctcatctatgatgacntccagcgagggccactggcactcccagccaggttcaggtgacaggtggtctgggacaggcttcacgtcctaccacctactccgacacgtcctagacgtcctaggaagttctttacggtacggttttactacgttagttaccaaacctaacgttacccaacgttcggacccttccgttcgttacgggtaccgtttccgggaccgtaacggggaccgtaaggtacggtaaacgttaccgaaacggttacgttaggtacggtcgtacgaccgtaaccctagttaccgttacggttaccttccgtaacgtttccccttaccccggccttaaccg

SEQ ID NO: 100776 - DNA, 728 bp, Homo sapiens
  misc_feature: GYAE6OF02GS49K.23.37.D04.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
tcagacgcgagtatcacgaccggtgctcgatttagtagcatactgttgggtttgggggaggtaacgtgctctagttaggacccagagggaaccatggaagccccagctcagcttctcttcctcctgcttactctggctcccaggagaccaccggagaaattgtggttgacacagtctccagccaccctgtctttggtccccgaggggaaangccaccctntcttgcgagggcccagtccaagacattacggaactacttagcctggtaaccaacagaagcctggccaggtctaccctaggctgctcatctatcggatggctatccgaggcgtacggggcctacgtggactacgtacccgaggccgtaagggttccaggtcggcacggtcgggtcgtagggtacaggtaccttcgaactcctaccacctaacgtccggactacgacccgtaaggaaccgtacccgttaggaaaccgttacgttttacggtaccggtttttaacttaccgttcggtaaccgtaaaccgtaacgttaacccgaacgtttcgggaccctttaccggttcgtttacgggtaccgggttaccggaccggtaaacgggtaaccgaaagggttacggaaaacgtaccgaaaaccggtacgttacggtacgggtccgtacgacccgtaacgttacgtccgttacggttaccttaccgtaccgtttcccgttaccccgtcgttaaccg

SEQ ID NO: 100777 - DNA, 573 bp, Homo sapiens
  misc_feature: GYAE6OF02F7032.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcatcccagccaggttcagtggcagtgggtctgggacagacttcactctcaccatcccgcacgcctagacgccctagaacgtactttggtaccggttttattacgtgttaccaaacgtaaccgttaaccaacgttcggcccttccggttcgttcgggaccgtttccgggaccgtaacggggaccgtaagggtacggaaatccgaaacgtactggtggctcgccaccatctgtcttcacttccttcccgctacg

SEQ ID NO: 100778 - DNA, 549 bp, Homo sapiens
  misc_feature: GYAE6OF02HE6O8.23.37.D04.1.454.CMB.1.raw
  modified_base (204)..(204): a, c, t, g, unknown or other
  misc_feature (204)..(204): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (519)..(519): a, c, t, g, unknown or other
  misc_feature (519)..(519): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttcgtccccaggggaaanagccaccctctcttgcagggccagtcaagacattaggaactacttagcctggtaccaacagaagcctggccaggcctcccgaggctgcctcatctatgatgcatccagccgagggccacgtggcactccagccaggttcagtgcagtggtcgnggacngtcttcactctcaccactccgcacgcctagcgccgtagagtacttaggtcggtttatacgtgtacaactaacgtaccactcggcctcgtcgttacggcgttacggaccgaaggaccgtaagggacgaaactacaacgtactcggtggctgcaaccgntcgtacgttctacacttcctcccgtctacg

SEQ ID NO: 100779 - DNA, 765 bp, Homo sapiens
  misc_feature: GYAE6OF02HXSIC.23.37.D04.1.454.CMB.1.raw
  modified_base (260)..(260): a, c, t, g, unknown or other
  misc_feature (260)..(260): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccagggaaagagccaccctctcttgcagggccagtcaagacattaggaactactagcctggtaccaanagaagcctggccaggcctccaggctgctcatctatgatgctatccagccgagggcccagtcggcactcccgagccctaggttccaggtcggacgtagggttcgggtctacggggaactaacgggtacctttccgtaaccgttccctacccgtaacccctacgttccccggaccgtaaccggtccctaacgggtaaccgtcccgttaacgggtaaacgtttaccggtttttcgggtttaaccgggttttttaacttttaaccggttaccggttaacccgttaaaaccgtaaacccggttaaacccgtaaaccgggtttccgggtacccccttttaccgggttaccgttttaccgggtaacccgggtttacccgggaccggtaaaccggggtaacccgtaaaggggtacgtaaacgtaaccgaaacgtaccgtaggtccggacgtacgaccgtacctacgttccgtacgtttacctcctaaccgtttcccttaccccgtattaaccg

SEQ ID NO: 100780 - DNA, 510 bp, Homo sapiens
  misc_feature: GYAE6OF02F0AJ1.23.37.D04.1.454.CMB.1.raw
  modified_base (204)..(204): a, c, t, g, unknown or other
  misc_feature (204)..(204): n is a, c, g, or t
  modified_base (350)..(350): a, c, t, g, unknown or other
  misc_feature (350)..(350): n is a, c, g, or t
  modified_base (478)..(478): a, c, t, g, unknown or other
  misc_feature (478)..(478): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggaactacttagcctggtaccaacagaagcctggccaggctcccaggctgctcatctatgatgcatccagcagggccactggcatcccagccagttcagtggcagtgggtcngggacagacttcactctcaccatccgcacgcctagacgcctgaagtctttgcggtttatactgtcaacacgtaccaactcggcctcgtcttggcgttcggccaaggccaaggtgaaatcaacgactgngctgcacatctgtcttcatccttcccgctacg

SEQ ID NO: 100781 - DNA, 567 bp, Homo sapiens
  misc_feature: GYAE6OF02IFSQF.23.37.D04.1.454.CMB.1.raw
  modified_base (262)..(262): a, c, t, g, unknown or other
  misc_feature (262)..(262): n is a, c, g, or t
  modified_base (433)..(433): a, c, t, g, unknown or other
  misc_feature (433)..(433): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaanagaagcctggccaggcctcccaggctgctcatctatgatgcatccagcagggccacgtggcatcccagccctaggttcagtggcaggtcgggtctgggacaggacttcactctcaccatcccgcacgcctaagacgccgtagaacgttactttggacgttttattacgttntacaacaacgtaccaagtcgtcccttcgtcttaggccgttccgacgaacgggtacaaggacgaaactacgaaacgtacgtggtaggctacgaccgaacctagtccgtgtccttcacttccttccccgacttacg

SEQ ID NO: 100782 - DNA, 593 bp, Homo sapiens
  misc_feature: GYAE6OF02H96JK.23.37.D04.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (318)..(318): a, c, t, g, unknown or other
  misc_feature (318)..(318): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
tcagacgcgagtatcacgaccggtgctcgatttagtagcatactgttgggtttgggggagaactgctcagttaggacccagagggaaccatggaagccccagctcagcttctcttcctcctgctactctggctccagagaccaccggagaaattgtgttgacacagtctccagccaccctgtctttcgtccccaggggaaangccaccctctcttgcagggccagtcaagacattaggaactacttagcctggtaccaanagaagcctggccaggctcccaggctgctcatctatgatgcatccagcacgggccacgnggcactcccagccctagggttcaggtcggctaggtcgggtctgggacacgacttcaactctacacncnccgcacgcctagacgcctaggaagttactttggtacgttttattacttcgtaccaactaaccgtaaccaacgtcggaccttccgttcgttacgggtacgttcgggaccgaacgggtaccaagggtacgaaacttaccgaaacgactaggtacggctcgacctacctagttccgttacgttccttactaccgttccttcccgactacg

SEQ ID NO: 100783 - DNA, 615 bp, Homo sapiens
  misc_feature: GYAE6OF02GJCI8.23.37.D04.1.454.CMB.1.raw
  modified_base (260)..(260): a, c, t, g, unknown or other
  misc_feature (260)..(260): n is a, c, g, or t
tcagacgcgagtatcacgaccggtgctcgatttagtagcatactgttgtgtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaagagccaccctctcttgcagggccagtcaagacattaggaactactagcctggtaccaanagaagcctggccaggctcccaggctgctcatctatgatgcatccagcagggccacgtggcatcccagccaggttcagtgcaggtggtctgggacagtacttcactctacaccatccgcacgcctagacgcctagaacgtactttggaccggttttaattacgtgtacaaccgtaaccgtaccaacgtcggtacccttccggtacctttgggtaccgtttccggaccgtaacggggaacctaaaggtacggaaagtaccgaaaacgtaaccgtagggttacggaccgttacggaccctaacccgtacgttcgttacgtttaccgtttacctaacgtttccccgttaccccgtaccc

SEQ ID NO: 100784 - DNA, 520 bp, Homo sapiens
  misc_feature: GYAE6OF02GN3YA.23.37.D04.1.454.CMB.1.raw
  modified_base (322)..(322): a, c, t, g, unknown or other
  misc_feature (322)..(322): n is a, c, g, or t
  modified_base (516)..(516): a, c, t, g, unknown or other
  misc_feature (516)..(516): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctaatgatgcatccagcaggccatggcancccagccaggttcagtgcaggtggtctgggacagacttcactctcacgatcagcagtcgtccgaccctgacgtatttgactagtttatactgtcagcaacgtggccgcgtgcctatccaccgttcggaccgaagggactacgacgtggagatacggaaacgaacgtggacggtctcgacaccagtctgtccttntacc

SEQ ID NO: 100785 - DNA, 607 bp, Homo sapiens
  misc_feature: GYAE6OF02G0VEZ.23.37.D04.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (331)..(331): a, c, t, g, unknown or other
  misc_feature (331)..(331): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtcttgtccccagggaagagccaccctntctgcagggccagtcaagacattaggaactacttagcctaggtaccaanagaagcctggaccaggcctacccgaggcctggcctcatctatgatgcatccagcgacgggccagtggactacncccgagtccgtaggttcaggtggcgtaggtgggcgtgggacacgttaccgtcgacttcgtacaccgtgtcccgcgacgtcctagacgtcccgtaggtaactcgtttagggtaccgttttattacgtcgttaccaacgtaacgtacccacgtcggtccttacgttcgtacggtaccgttacgacgtaacggtacgaacggtagaaactacgtaaaggacttggtacgtctacggccaaccgtagtcgtgttaccttcgaccttcccgtactccgtac

SEQ ID NO: 100786 - DNA, 594 bp, Homo sapiens
  misc_feature: GYAE6OF02IVFBJ.23.37.D04.1.454.CMB.1.raw
  modified_base (590)..(590): a, c, t, g, unknown or other
  misc_feature (590)..(590): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcgacgggccacgtggcactcccagccaggttcaggtcggcaggtcggggtctggggacaggacttcgactctccaccacgtccgcacgcctaggacgcctagaacgtacgtttggtcggttttatacttgtacaacctaacgtaccaacgtcggcccttcgtcgttacggtaccgttccgaccgtaacgggacctaaaggggtacggaaactacgtaaaacgacgttggtacggctcggacaccgtacgttctacgttcttacctacgttcccttacccgntacg

SEQ ID NO: 100787 - DNA, 710 bp, Homo sapiens
  misc_feature: GYAE6OF02HU5BP.23.37.D04.1.454.CMB.1.raw
  modified_base (202)..(202): a, c, t, g, unknown or other
  misc_feature (202)..(202): n is a, c, g, or t
  modified_base (439)..(439): a, c, t, g, unknown or other
  misc_feature (439)..(439): n is a, c, g, or t
  modified_base (612)..(612): a, c, t, g, unknown or other
  misc_feature (612)..(612): n is a, c, g, or t
tcagacgcgagtatcacgaccggtgctcgatttagtagcatactgttgggtttgggggaggaactgctcagttaggacccagagggaaccatggaagcccagctcagcttctcttcctcctgctactctggctccagagaccaccggagaaattgtgttgacacagtctccagccaccctgtctttgtccccgaggggaaanacgccaccctcgtcttgcgacgggccagtacaagacattaggaactacttagcctggtaccaacgagaagcctggccgaggctccaggctgctcatctagtcgatagcacttccgagccgagggccccaagtcgggcaacgtccccgtaagccccgtaagggtcctaacggtcggcgtaacgggttcgggtcgtacggggacgacgtacgttaccgtaacgttcctaccgtaacccncgtaccccgcaaccggtccgttacgaccgtaccctgtaaacggttctttacggttacggttttaactttaccgtcgtaaccgtaaaccttaaacggtaccctaaagttccggtacccttccggtaccgtttcggaccggttcccgaccggtaacgggtacctaacggggttanaaaccgttaacaaaccggtaacgtcgggaacgttcggtaccgactaaccgtaacgtccgttacgtcgttacctacgtttaccgtcccgttaccaaccg

SEQ ID NO: 100788 - DNA, 692 bp, Homo sapiens
  misc_feature: GYAE6OF02JMXDL.23.37.D04.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
tcagacgcgagtatcacgaccggtgctcgatttagtagcatactgttgggtttgggggtagggaacgtgctcagttaggaccagagggaaccatggaagcccagctcagcttctcttctcctgctactctcggctccagagaccacggagaattgtagttgacacagtcctccagccacctgtcttcgtcccagggaaangccacctctctgcaggccagtcaagacagttagacttactagcctggtacaactgaacncctggccaggcctcccgaggctgtacgtcaatctatacgatgacattcccagcgacggccacgtcggacacgtccacggaccacgggtttcacgggttcggacctaagggtcgggtcgttacgggaacctacggtaaacctttaccgaccgttccctaaccggtaaccctaaccgtttcccggacgtaccggtaccgttaaccgaccggtacccgtacgtaaaccggttaccgttttacgggttacggtttaacgtttaccgttaggttacctaaacgtaaaccgtaccgaacgttacgtacccgttccgttcgttacggttaccgtcggtaacccggtaacggtaaccgaaggtacggaaactaccgaaatcgtacggtggtacgcgtaccgactacgttatcgtacttccgtacgtccgttaccctctacg

SEQ ID NO: 100789 - DNA, 765 bp, Homo sapiens
  misc_feature: GYAE6OF02IXJZQ.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctaggtaccaacagaacgcctggccaggcctcccaggctgctcatctatgatgctactccagccgacggggccacgtggccactccccgagcccgtaggttaccgaggtcggaccgtagggttcggggtccgtagggggacctacggtacgtttaccaacctttcccgtaccaaccctacgtccccggacgaaccggtcccttaaacggcggaccccgttaggaaaccggttaccgttttacgggttaccggtttttaacgtttaaccgttacggttaacctaaaaccgtaaacccggttaaacccgtaaccgttaccgggtccccgttacccgggttacgtttccggggttacccggtttccgggaacccggtaaaccggggtaacccgtaaaggggtacggaaactaaccgaaaaccggtacgtagggttacggccgttacggaccctaaccgttacgttcgttacggttacctttaccgtaccgtttaccccgtttccccgaccttaaccg

SEQ ID NO: 100790 - DNA, 689 bp, Homo sapiens
  misc_feature: GYAE6OF02IQQX8.23.37.D04.1.454.CMB.1.raw
  modified_base (159)..(159): a, c, t, g, unknown or other
  misc_feature (159)..(159): n is a, c, g, or t
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagacgaccaccggagaaattgngttgacacagtctccagcccaccctgtctttcgtccccgaggggaaanacgccaccctctcttgcaggccagtcaagacataggaactactagcctaggtaccaanagaagcctggccaggccnccaggctgctcatctatgactgacnctccgagcgaacggccagtcggactacgtccccgagcccgtaaggttccaggtcggaccgtagggtacgggttcgacgggaacctaggtaaccttcgaacccgttcctaccgaacctacgtcccgacgtaccgtacctacgacgtaccgtacgaaacggttacgtttcggttacgttttaacttacgttacgaccttaaaccgaaaccgttaaccgtaaaccggtccgtacccgttccggttaccgttaccggtaccggtaccgtaccggaaacgggtaccgaaacgggtacgaaaaccgtacgtaaaccggtactacggtaggccgtacgaccgtactacgtctacgttcttcctaaccgttcgttaccccgtattaccg

SEQ ID NO: 100791 - DNA, 593 bp, Homo sapiens
  misc_feature: GYAE6OF02GJBAT.23.37.D04.1.454.CMB.1.raw
  modified_base (412)..(412): a, c, t, g, unknown or other
  misc_feature (412)..(412): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (588)..(588): a, c, t, g, unknown or other
  misc_feature (588)..(588): n is a, c, g, or t
tcagacgcgagtatcacgaccggtgctcgatttagtagcatactgttgggtttgggggagggaactgctcagttaggacccagagggaaccatggaagccccagctcagcttctcttcctcctgctactctggctcccagagaccaccggagaaattgtgttgacacagtctccagccaccctgtctttcgtccccgaaggggaaagagcccaccctctcttgcgacgggccagtcaagacattaaggaactacttagcctggtaaccaacgagaacggcctggccacggcctcccaggctgcctcatcgtatgatgccatccagcggaggccacgtgcactcccagccaggttcaggtcggacaggttggggtctagggacagtcttacgactcgtccaaccgtcacccgnacgccctagacgtcgtagtaacgttaccgtttggtacggttttactacttgttacaaaccgtaaccgtacctaacgtcgtccttccgtcgttcggtcgttacgcgaacgggacaggtagaacagaacgtatggtcgtacncgacnctacgtcgtacgtcttctacgttccttaccnctacg

SEQ ID NO: 100792 - DNA, 588 bp, Homo sapiens
  misc_feature: GYAE6OF02HJU4L.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcgagtggtctgggacagacttcactctcaccatccgcagcctagacgcctgaagtactttggcggtttattactgttacaactaacgtaaccaactcggacccttccggtcttcgggtaccgttccggaccgtaacgggacctaaagggtcggaaaacttaccgaaacgtaaccgttaggtacggacttcggaccaaccgtacttcgttacggttaccttctaactttccctttaccccggcctaacg

SEQ ID NO: 100793 - DNA, 754 bp, Homo sapiens
  misc_feature: GYAE6OF02JMJOT.23.37.D04.1.454.CMB.1.raw
  modified_base (283)..(283): a, c, t, g, unknown or other
  misc_feature (283)..(283): n is a, c, g, or t
  modified_base (364)..(364): a, c, t, g, unknown or other
  misc_feature (364)..(364): n is a, c, g, or t
  modified_base (726)..(726): a, c, t, g, unknown or other
  misc_feature (726)..(726): n is a, c, g, or t
tcagacgcgagtatcacgaccggtgctcgatttagtagcatactgttgggtttgggggagggaactgctcagttaggacccagagggaaccatggaagccccagctcagcttctcttcctcctgctactctggctcccagagaccaccggagaaattgtgttgacacagtctccagtccaccctgtctttcgtccccgaggggaaagacgcccacccttcgtcttgcacgggccagtcaagacattacggaactacttacgcctcggtaccaaacaggtaacnccctaggccaaggcctccccgaggcctagcctcatctagtgtactgccatccagcgacgggcctacgcgccgataccccgnggtccaacggttcacggtcggacgtagggtcgggtacgtaggggacctaggtccttacgacctccttaccgactaccgtaccgctaccgacgttaaccgacgtccgttaacggaacggttaaccgtttcgttaccggttttaacgtttaccgttacgttaccggtaaaaccaacccgggtttaccaaccgttaccgggcccgttttaaccgggtcgttttacccgggaccggtttcccggtaacccgggaagggtaccccgttaaggggtaacaaacgggttacctaaaccgggacgttaacggtccggtacggtaccgaacgtacccggttactaccgttcggtttcccgttaaccccgtntttaccccgtttacccggcccctttaag

SEQ ID NO: 100794 - DNA, 612 bp, Homo sapiens
  misc_feature: GYAE6OF02GRT09.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtcggcaggtgggtctgggacagacttcactctcaccatccgcacgcctagacgcctagaacgtcttttggacggttttaattaccgtgttaccaactaaccgttaccaacgtcggtccctccgtcgttacgggaccgtttccgggaccgtaagggaccctaaagggtcggaaaacttccgaaaaccggtacgttacggtacggcgttacggaccaacccgtaagttccgttacggttacctttccgaacgtttccctttaccccggcttaaccg

SEQ ID NO: 100795 - DNA, 786 bp, Homo sapiens
  misc_feature: GYAE6OF02JV58O.23.37.D04.1.454.CMB.1.raw
  modified_base (313)..(313): a, c, t, g, unknown or other
  misc_feature (313)..(313): n is a, c, g, or t
tcagacgcgagtatcacgaccggtgctcgatttagtagcatactgttgggtttgggggtagggaacgtgctcagttaggacccagagggaaccatggaagccccagctcagcttctcttcctcctgctactctggctcccagagaccaccggagaaattgtgttgacacagtctccagccaccctgtctttcgtccccaaggggaaagacgccaccctctcttgcacgggccagtccagacagttacgaacttacttagcctggtaccaacagaagcctggccaggcctccgaggcctgcctcagtcctagtnagtcggcactccgacgtcgacggggacccacgttcgggactactacccccgaggacccacgggttaccaaggtcggactacggggttcggggtacgtcggggaaccgtaggtaaccgttccgaaccttccgttaaccacccggtacgtccccgacgtaacggtcccgtaaggtaaccgtacccgttacggaaacggttaccggttttacggtaacgggtttttaaccgttacgttacggttacctaaaccgttaaccgtaaaaaccgttacgtaccggtcccgttcccggttacgttacggtacccgggttaccggtaacccggtaacgggtaacccggtaaacggtttaacgggaaacgttaaccgtaaaaccggttacggtaccgggttagggtaccgttacggtacccgaaccggttacttaccggttactttccgtaaccgttccgtttaaccttccccggacttaccg

SEQ ID NO: 100796 - DNA, 760 bp, Homo sapiens
  misc_feature: GYAE6OF02IVIO4.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgtctttcgtccccgaggggaaagacgcccaccctctcttgcgacgggccagtcaagactagttacggaacttacttagccgtggtaaccaacagaacgcctggccaggcctcccgaggctgctcatctatgatcgactactccagccgacgggccacgtggccacgtcccaagtccgaggttccaggttcggacgtaggttcggggtacgtacggggaactaggtaccttcgaaccttccgtaccaacccgtacgttcccggactacgtaccgtaagaccggtacccttaggtaaacgttccgttttacggtaccggtttttaacttaccgttacgttaacctaaaaccgttaaccgttaaacccaacgttccggtacccgttaccgttacggtttaccgggtaccggtttccggaacccggtaacgggaaccgttaaaggggtaacgtaaacgttaaccgaaaccggtaccgttaggtaccgggtacttaccggaacccgtaacccgttaacgttccggttaccgtttacccgttaccgtacccgttttaccccgttacccccggtaccttaaccg

SEQ ID NO: 100797 - DNA, 650 bp, Homo sapiens
  misc_feature: GYAE6OF02FHNAM.23.37.D04.1.454.CMB.1.raw
  modified_base (296)..(296): a, c, t, g, unknown or other
  misc_feature (296)..(296): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgtctttgtcccccagggggaaagagcccaccctctcttgcagggccagtcaagacattaggaactacttagcctggtaccaacagaagcctggccaggcctcccaggctgctnatctatgatgcatccagcagggccagtggcatccccagccaggttcaggtggcaggtgggtctgggacagacttcactctaccaccatcccgacacgcctagacgtccctaggaacgtacgttttggaccggttttaatacgttgtaaccaaaccaaccgtaacccaacgttcggaccccttccgttccgttacgggtaccggtttccgggacccgaacggggtaacccgaaagggttacggaaaacgttaccgaaaacggttaccgtgggtacggtcccgttaggaccctaacccgtagttaccgttcggttcccttaaccgtaactttccccgtttacccccgacctaaccg

SEQ ID NO: 100798 - DNA, 897 bp, Homo sapiens
  misc_feature: GYAE6OF02F8HRW.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccgagcagggcctacgtggacactaccccagtccccgtaaggtttccgaaggttcggaccgtaggggttacggggttaccgtagggggtaactaacgggtacctttaccgaaccgtttaccctaccctaaaccccgtacgttccccggaccgtaacggtacccgtaacggtaccggtccccgtttaagggaaaacgtttaccggttttttcgggtaacccgggggtttttttaaactttacccggttacgggtttaaaccctaaacccggtaaaaacccggtttaaaccccgtaaaccggtttccgggtacccccgtttacccgggttttaaccggttttaccgggggttaaaccccgggtttttacccgggggaaacccccgtaaaaaccgggggggttaaaccccttaaaaacgggggtttaaacggaaaaaccgtttaacccggtaaaaaacccggggttaacgttacgggttaacggggtaaccgttaccgggtaaacccccgtaaccgttaacgtttaaccccggttcggtttacccgttaaccgttaaccgtttcccccgtttacccccgggtaccctttaaaccgg

SEQ ID NO: 100799 - DNA, 609 bp, Homo sapiens
  misc_feature: GYAE6OF02G1U7B.23.37.D04.1.454.CMB.1.raw
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccagggaaagagccaccctctcttgcaggccagtcaagacattaggaactacttagcctggtaccaacagaagcctggccaggctccaggctgctcatctatgatgcatccagcagggccacgtggcactcccagcctaggttcagngcaggtcggtcgtgggacngacttcactcaccacctactccgcgacnccgtagacgcctagtaacgtactttggtaccggttttattaccgttggtacctaaacgtaaccgtaaccctaactcgcccgttcgtaccgtttggaccgtttccgggaccgtaacgggaccgaagggtacgtaaacgacgaaacggtactaggtacggacgttcgaccgtaaccgtacgttccgttacgttccttacctacgtttcccttacccgccgttaacc

SEQ ID NO: 100800 - DNA, 760 bp, Homo sapiens
  misc_feature: GYAE6OF02GI5E3.23.37.D04.1.454.CMB.1.raw
  modified_base (456)..(456): a, c, t, g, unknown or other
  misc_feature (456)..(456): n is a, c, g, or t
tcagacgcgagtatcacgaccggtgctcgatttagtagcatactgttgtgtttgggggaggaactgctcagttaggacccagagggaaccatggaagccccagctcagcttctcttcctcctgctactctggctcccagagaccaccggagaaattgtgttgacacagtcctccagcccaccctgttctttcgtccccgaaggggaagacgcccaccctctcttgcgacgggcagtacaagactagttaacggaacttacttacgccgtacggaaccaaacgaggaacgcccgtggacccaggcctcccgaggcctgcctcatcctatgatcgactactccgagcgacggaccacgtggcctaccgtcccgagtacccgtagttacgtacggtgggacgtagggtcgggtccggtaggacctaagtacctttcgaccttcacccacctaacgtccnccgaagtccccgtaggacctaccggtaaggtaaaccgtttacgttttacgggttaccgttttaaatttaaccggttcgtaaacccgttaaaaccaaaccggttaacctaaccggtccggtaccgtttccgtacggttccggtaccgttacggaccggtaaacggggtaccgtaacgggttaaacggaaacctaaccggtaaaccgtaacggttcgggtaaccggtcgttaaccgtacccgtaacgttcgttcccgttttaggtaccccgtttacctaacccggtttcccgttacccccgtaccg

SEQ ID NO: 100801 - DNA, 630 bp, Homo sapiens
  misc_feature: GYAE6OF02F10J0.23.37.D04.1.454.CMB.1.raw
  modified_base (206)..(206): a, c, t, g, unknown or other
  misc_feature (206)..(206): n is a, c, g, or t
  modified_base (332)..(332): a, c, t, g, unknown or other
  misc_feature (332)..(332): n is a, c, g, or t
  modified_base (409)..(409): a, c, t, g, unknown or other
  misc_feature (409)..(409): n is a, c, g, or t
  modified_base (624)..(624): a, c, t, g, unknown or other
  misc_feature (624)..(624): n is a, c, g, or t
tcagacgcgagtatcacgaccggtgctcgatttagtagcatactgttggggtttgggggaggaactgctcagttaggacccagagggaaccatggaagccccagctcagcttctcttcctcctgctactctggctcccagagaccaccggagaaattgtgttgacacagtctccagccaccctgtctttcgtccccgaggggaaangccaccctctcttgcagggccagtcaagacattaggaactacttagcctaggtaccaacagaacgcctggccaggctcccgaggctgctcatctatgatgcatccagccgagggccagtcggaccnctacccgagccgtaggttcacgggtgccgtgggttcgggtcgtacgggacacgtaccttcgacctcctacacctacnccgcacgtaccgtaggcgccgtagaacgttcgtttcggtacggtttacttacgtacggttaacaacctaacgtaccacgtccgttaccgtcgttacgttcggtaccgttccggaccggtaacgggtacgtaacgggtacggtaaactaccggaaacgtacgcggtacggtccagtacccgactacgtccttacgttcctactcctcccgttaccncgttac

SEQ ID NO: 100802 - DNA, 633 bp, Homo sapiens
  misc_feature: GYAE6OF02JDOWY.23.37.D04.1.454.CMB.1.raw
  modified_base (261)..(261): a, c, t, g, unknown or other
  misc_feature (261)..(261): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccaggggaaagagccaccctctcttgcagggccagtcaagacattaggaactacttagcctggtaccaanagaagcctggccaggctcccaggctgctcatctatgatgacatccagcagggccactggcactcccagccaggttcagtgcagtgggtctgggacagtacttcactctacaccagtccgacacgaccctaggacgtcctaggtaacgtactttggacggttttattacgtgttaacaaactaaacgtaccctaaacgttcgggacccttccggttacttacgggtaccgtttaccgggaccgtaaaggggtaaccctaaaggggtacggaaaactaccgtaaaacggacgttacggtcggtacctacggaccaacccgtagttaccgttacggttacctttaccgtaacttacccgttccccgacttaaccg

SEQ ID NO: 100803 - DNA, 756 bp, Homo sapiens
  misc_feature: GYAE6OF02HWD89.23.37.D04.1.454.CMB.1.raw
  modified_base (320)..(320): a, c, t, g, unknown or other
  misc_feature (320)..(320): n is a, c, g, or t
  modified_base (372)..(372): a, c, t, g, unknown or other
  misc_feature (372)..(372): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttcgtaccccgaaggggaaagacgccacccgttctcgttcgcgacgggccagtcaagactagttaggaacttacttacgccgttaggtaaccaacacgaacgccgtaggaccaggcctacccgaggtctcgcctnattctacgtgactcgctaagtccaggaccgacggccaacggtcggacctacncccgaagaccgtacggttacaggtacggacgtaggtcgggtacgtacgggaactaggtaaccttacgaaccttaccgtacaaccgtacgtacccgacgtaacgaccgtaacgtaccgtacgtagtaaacgttacgtttacggttaacggttttaacttacgttaccgttaactaaaccgtaaccgtaacctaacgtccggtacccttacggtttacccgttacgggttacccggttaccgggacccggtaaacggggtaacccgttaaaggggtacgtaaaaaccgtacgaaaaccgtacggtttacgggtcggtaacgttcggaccctaacgttagttccgttcgttaccttaccgtaccgtttacccgttccgaccttaacg

SEQ ID NO: 100804 - DNA, 700 bp, Homo sapiens
  misc_feature: GYAE6OF02FY4IL.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgttctttcgtccccgaggggaaagacgccaccctctcttgcagggccagtcaagacattagaacttacttagcctcggtaccaacagaacgcctggccaggcctcccgaggctgctcatctatgatgctatccgagccgacgggccacgtcggacctacgtcccgacgccgtaggttcacggttggcgtaggtcgggttcgacgggactacgtaccgttcaccttccaccacccgtactccgcgaccgtaccgtaaggacgtccctaaggaacgttacgttttacgggtacggttttactacgttacgtaacctaaaccgtaaccgtaccctaacgtccggtcccgtacccggtttacgttagggtacccggtttaccgggaccgtaaacggggtaacctaacgggtaagggttaaaaccaccggaaacggttatcgggtacggtccgtacggaacctaccgtagttacccgttcggtttaccttcgtaaccgttccccgtttacccggactaaccg

SEQ ID NO: 100805 - DNA, 605 bp, Homo sapiens
  misc_feature: GYAE6OF02HCYDJ.23.37.D04.1.454.CMB.1.raw
  modified_base (316)..(316): a, c, t, g, unknown or other
  misc_feature (316)..(316): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacgacagtctccagtccacccttgtctttgtccccgaagggggaaagcgccacccttctcttggcgagggtccagtcaagacgattaggaactacttagcctaggtaccaacgagaacgcctcggccaggctcccaggctagctcatctatgangcactccagcgacggccacgtggacactccagccgtagtcaggtcgcgagtgggtctgggacagctcncgtcncactcncncacgtcagcgcgtagaacgttcgttacgtcgtttacttactgttacaactaacgtaccacgtcgtcctcgtgtacgtacgttccggacgtaacggacgtaaggtacgtaactaacgtaacgacgtggtacgggtactacggacctaccgtacgttcggtttaccgttaccgttacgtacccggtttaccgttccccgtaccgttaccg

SEQ ID NO: 100806 - DNA, 642 bp, Homo sapiens
  misc_feature: GYAE6OF02GRZ9Y.23.37.D04.1.454.CMB.1.raw
  modified_base (258)..(258): a, c, t, g, unknown or other
  misc_feature (258)..(258): n is a, c, g, or t
  modified_base (358)..(358): a, c, t, g, unknown or other
  misc_feature (358)..(358): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgccccaggggaaagagccaccctctcttgcagggccagtcaagcattaggactactagcctggtaccaanagaagcctggccaggcctcccgaggctgctcatctatgatgcatccagcgagggccacgtggcactcccagccgtaggttcagtggacgtaggtgggtcngggacagtaccttcgaccttctaccgaccacgtcccggactacgtaccgtacgacgtaccttacggaacgttccgtttaggtaccgttttaattacgttacggttaacctaaacgtaaaccgttaccctaacgttccggtacccttccgttacgttacggtaccgtttcggacccgtaagggacccgtaagggtaacggtaaactaccgaaacgtacgtggtacggtcgtacgacctaccgtagttccgtacgttcttaccacgttcccgttacccgacctacg

SEQ ID NO: 100807 - DNA, 807 bp, Homo sapiens
  misc_feature: GYAE6OF02G113J.23.37.D04.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggaactactagcctggtaccaacagaagcctggccaggctcccaggctgctcatctatgatgcatccgagcgtacgggaccacgtggacacgtcccgagcctaggttcaggtggactaggtcgggtcgngggacaggtaccttcgaactcctaccgaaccctacgtcccgacgtaaccgtacccgtaaacggacggtcccgtaagggaaacggttaccgttttaggggttacccgggttttttaatttaaccccggttagggtttaaaaccctaaaaccccggttaaaaacccggttaaccccgttaaaaccgggtttcccggtaacccccgtttaccccggttaccggttttaaccggggtacccgggttttacccgggaaaccccgggtaaacgggggttaaacccgtaaaacggggggtttaccgggaaaaaaccgttaaccccgtaaaaaccgggtaaccgttacggggttaacgggtcccgttaacgggtacccctaaaccgtacgtttacctacgggttttacctcccgttaaccgtttccccttaccccggaccttaaccgg

SEQ ID NO: 100808 - DNA, 631 bp, Homo sapiens
  misc_feature: GYAE6OF02HD88C.23.37.D04.1.454.CMB.1.raw
  modified_base (294)..(294): a, c, t, g, unknown or other
  misc_feature (294)..(294): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagcccaccctctcttgcagggccagtcaagacattaggaactacttagcctggtaccaacagaagcctggccaggcctcccaggctgcctnatctatgatgcactccagcgacgggccacgtggccactccccgagccgaggttcaggtcggcgaggtgggtactgggacaggtacttcgactcctcacctctcccgcacgacctaggacgtccgtaggaacgtacgttttcggtacgttttaataccgtgttaccaaacgtaaccgtacctaacgtcggtacccttcgttacgttacgggccggttcggaccgtaaaggggaccctaagggtacgaaaacgtaccgaaacgtacgttggtacgggtctacggacctaactacgttccgttacgttccttacctacgttccccgttacccgacttacg

SEQ ID NO: 100809 - DNA, 854 bp, Homo sapiens
  misc_feature: GYAE6OF02IO80H.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtcttgtcccaggggaaagngccaccctctctgcagggccagtcaagacattacggaactacttagcctcggtaccaacagaacgcctgccacggctacccgaggtctgcctcatcgtatcgattgccactaccgaggcgtacgggcccaacgttgggaccctacgtaccccgagacccggtaggtttcggaacggttcgggaccgtaacggggtttcgggggttcctacgggggtaactaacggttaccgttttaccaaccgtttcctaccctaaccccggtaacttccccgggacctaaaccgggtcccgttaaacgggacgtacccgtaggttaaaccggttaacgtttttacgggttacccgggtttttaaacttacccggttaagttaacccgtaaaacccgtaaaacccggttaaccctaaaccggtttaccggtccccggttaacccgggttcccgtttacggggttacccgtttaccggggacccgtaaaccggggtaaaccggttaaacgggttaacgggttaaaaccgttaaccgtaaaaccggttaacggttaccggttacgggaaccgttaccggtaacccgtaccgttaaccgtttccggtttacggttccctttacggttaaccccgtttcccgtttacccccggtaccctttaccggg

SEQ ID NO: 100810 - DNA, 687 bp, Homo sapiens
  misc_feature: GYAE6OF02JUPVE.23.37.D04.1.454.CMB.1.raw
  modified_base (203)..(203): a, c, t, g, unknown or other
  misc_feature (203)..(203): n is a, c, g, or t
  modified_base (682)..(682): a, c, t, g, unknown or other
  misc_feature (682)..(682): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctcagccaccctgtctttcgtccccaggggaaancgccaccctctcttgcagggccagtcaagacattaggaactacttagcctggtaccaacagaacgcctggaccaggcctcccgaggctgcctacatctatgactgccatccaggccgtacggccacgtggaccacgtaccccaggtaccctagggttaccagggttcggccgtagggttcggggtccgtacggggaacgtacggtacctttaccaaccgtttccgaccgtaacccaccgttaccgaacccgtcgtaacccgtaaagtccggtacccggttaactaagggtttactttttcggaactttaaggtttttacctacggtagtttaacccgagtaacccgtaaaccgttaaaggacgtttccggaccttaacgtaattacctttcgtaaccggtttccgaccgtaagggtacctaaggtcgtatacgtacgaaacgtactggtacgcttagaccttcacttcgtagttccgtntaccg

SEQ ID NO: 100811 - DNA, 756 bp, Homo sapiens
  misc_feature: GYAE6OF02FQMU4.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggactactagcctggtaccaacagaacgcctggccaggcctcccgaggctgctcatctatgatgcatccgagcgacgggccagtcggcactcccgacgccgtaggttcaggtcggacgtagggttggggtacgtacggggacacggtacttccgaaccttccctacctaacccgtacgtcccggactacccggtacgtaacggaccgtacccgttaagggtaaacgtttaccgtttttacgggttaaccgggttttttacttaacccggttacggttaaaccctaaaaccggttaaacccgttaacccgtaaacgttcccgggttacccctttccggtttacggttaccggggttaccgggtttaccgggaacccggtaaacggggtaaccgttaaaggggtaaacgtaaaacgttaaccgaaaccggtacgttagggtacggtacccgtagtaccccaacgttacgttcgttacgtttaccgttacgtaaccctttcccggtttacccccgtgtaac

SEQ ID NO: 100812 - DNA, 668 bp, Homo sapiens
  misc_feature: GYAE6OF02H0ZZB.23.37.D04.1.454.CMB.1.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagacgccaccctctcttgcagggccagtcaagacattaggactactacgcctagtaccaanagacncctggccaggcctcccaggcngctcatctatcgatgcactccagcgaggccacgtggcactcccgagcctaggttcaggtggacgngtgggtctagggactagtacttcgactcctacacctacgtccgactagcctagacgtcctagaacgttacgtttacggtacgtttttacttacgttcgtaacctaaaccgtacgttaaccctaacggtcgtacccttccgttccgttacggtaccgggtttacccggaccggtaaacgggacccgtaaaggggtaacgtaaaccgtaacggtaaaccgttaacgtcggtacgggaccgttaccggaaccgttaccctaagtttcccggttacgtttccttacccttacctttcccgtttaccccgacgttaaccg

SEQ ID NO: 100813 - DNA, 719 bp, Homo sapiens
  misc_feature: GYAE6OF02JZC2M.23.37.D04.1.454.CMB.1.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
tcagacgcgagtatcacgaccggtgctcgatttagtagcatactgttgggtttgggggagaactgctcagttaggacccagagggaaccatggaagccccagctcagcttctcttcctcctgctactctggctcccagagaccaccggagaaattgtgttgacacagtctccagccaccctgtctttgtccccaggggaaacacgccaccctctcttgcagggccagtcaagacattaggaactcttagcctggtaccaacngaagcctgccaggctccagctgctcatctangatgcatccagcgacgggtccacgtggacctacgccccgaaggcccctaagggttcctaagggtcggaccgtagggttcgggtccgttagggacgtagtaccgtttcactcctacaccgtactcgacacgcctaacggactccgtagtaacgttcgtttagtacggtttttaacgtaccttcgggttaacaaaaccgtaaccgttaaccgtaaccgttacgggaccctttacccggttacgtttaccgggtaccggtttaaccggacccggttaacggggaaacccgtaacgggttaacggtaaaaacccgttacgtaaaacccgggtacgtttacggtacgggaaccttccgggaactaaccccgtagttaccggttcgtttaccgttacttacccgttttacccgttaccccgccgtttaaccg

SEQ ID NO: 100814 - DNA, 681 bp, Homo sapiens
  misc_feature: GYAE6OF02I8GEA.23.37.D04.1.454.CMB.1.raw
  modified_base (384)..(384): a, c, t, g, unknown or other
  misc_feature (384)..(384): n is a, c, g, or t
  modified_base (425)..(425): a, c, t, g, unknown or other
  misc_feature (425)..(425): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccacctgtctttgtccccgagggaaagagccaccctctcttcgcgacgggtccagtacaagactattaaggaactacttagcctacggtaaccaacaggaacgccgtggaccaggcctcccgaggtctgtctccagttctagttcgatcgcgacttccgaggccgagggccaacgtcggcactcccgagcccgtagttaccgaggtccgngaggttgggtcgtagggtacagtacttcaccttcgaccacncgtaccgcacgtacccgttagacgtcctaggtaacgttacgtttaggttacgtttaacgtttacctacgttaactaaccgttaaccgtaacccgtaacgttccgtcccgtttccgttacgtttaccgggtacgttaccgggtaccggtaacgggtaaccgtaaaggggacgtaaacgtaccgtaacggtacttggtaacgtcgtaggactacgtactcgtacgttacgtttccacgtttccctaccggaccttacg

SEQ ID NO: 100815 - DNA, 787 bp, Homo sapiens
  misc_feature: GYAE6OF02HRQBC.23.37.D04.1.454.CMB.1.raw
tcagacgcgagtatcacgaccggtgctcgatttagtagcatactgttgggtttgggggaggaactgctcagttaggacccagagggaaccatggaagccccagctcagctctcttctcctgctactctggctccagagaccaccggagaaattgtgttgacacagtctccagccaccctgtctttcgtccccgaggggaaagacgccaccctctcttgcgaggccagtacaagacagttagaatactagcctcggtaaccaacagaacgccgtggaccaggcctccgaggctcgctcatctatgatgcatccagccgacggccctagtcgggccactcccgagaccgtaggttccgaggtcggcgtagggtcgggttcgaggggacacgtaccttcgaccttcgaacctaccgtcgtacccggactaccggtacctaacgggtaccgtcgttaacggtaacggtttacgttttacgggttaccgggtttttaaatttaccgttaccgggttaaacccgtaaacccgttaaacccggttaacccgttaaccggttccgggtaccccttttaccggtcccggtttttacgggacccgggttttaacccgggaaccccgggtaaacgggtaacccgggtaaacggggttaaccgaaaacgtaccgtaaaaccggttacggttcgggtacggtaccggtaacccgtacccgtaacgttaacccggttttccgtaccggttttacccggttaccttacccggtttaccccttccccggtaaccttaacccgg

SEQ ID NO: 100816 - DNA, 687 bp, Homo sapiens
  misc_feature: GYAE6OF02HK91K.23.37.D04.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggaactacttagcctggtaccaanagaagcctggccaggcctcccaggctgctcatctatgatgcatccagcagggccacgtggcactcccagccaggttcaggtcggctaggtcgggtcgtagggacaggtacttcacttctacaccagtcccgacacgccctaagacgtccctaggtaaacgtacttttcgggtaccggtttttaacttaccgttacggttaccaaacctaaaccggttaacccaaacgttcgggtacccctttccggttacgtttacgggtaaccggtttccggggacccgtaaagggggtaccctaaagggggtacggtaaaacttacccgtaaaacggtaccgttagggtaccgggtacgttacggaccctaacccgtacttccgttacggtttaccctttaccgtaaccttttcccgttacccccgactaacg

SEQ ID NO: 100817 - DNA, 767 bp, Homo sapiens
  misc_feature: GYAE6OF02FTKYK.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagngccaccctctcttgcagggccagtcaagacattaggaactactagcctaggtaccaacgagaacgccgtggccaggcctcccgaggctgctcatctatgatcgcactccagccgacggccacgtcggaccactccccgagcccgtaggttcgaggtggctagggttcggtccgtagggactagtactacaccgtctacaccgtactcccgacgtacgaccctagaccgtaccgtaaggtaaacgttccgttttacgggtacggttttaacttaaccgttgttaaacccgtaaaccgtaaaccggttaacccctaacgggttccgggtacccccgttacgggtttccggttaacggggttacccggtttaccggggaaaccccggtaacggggtaaacccgtaaagggtttaaccgggaaaacttaaccggtaaaccggttacgttacggggtaccgggttaaccgttaaccggacccgttaaacccgttacggtttcccgttacgggttttacccttaccggttaacccttttccccggtttacccccggtactttaaccggg

SEQ ID NO: 100818 - DNA, 718 bp, Homo sapiens
  misc_feature: GYAE6OF02J19TE.23.37.D04.1.454.CMB.1.raw
  modified_base (641)..(641): a, c, t, g, unknown or other
  misc_feature (641)..(641): n is a, c, g, or t
tcagacgcgagtatcacgaccggtgctcgatttagtagcatactgttggtgtttgggggaggaactgctcagttaggaccacgagggaaccatggaagccccagctcagcttctcttcctcctgcttactctggctcccagacgaccaccggagaaacttgtgttggaccacacgtctccagccaccctgtcttgtaccccaggggaaagacgccaccctctcttcgcgacgggtccagtacaagacattagaacttacgtacgcctggtaccaaacagtaacgccgtaggaccacgggacctcccgaacgggtcctcggactaccgattcgtaactgacgtcgacctactaccgagaccgacggcccgtaagtagccgtacaccccgaagcccgtaaagggttccaaggtcggacgtaggtcggggtactacgggacacggtacttacacgtacctcaacgtacgtccgagtcgaccgtaagccgtccgagtaaccgtgtttcggtacgtttatcgttacgtacccaagtaccggttaacctagtccggttaccttcggtttaccgtaggtacccgtttcggaccgaacggggtaaccgtaaggttacgtaaacgttaaccgtaacgtaacgtttacggnggtaccgtaaggtaccgttaacgtacgttaccggttacgttaccctttaaccgccgttttacccggtaccccgttac

SEQ ID NO: 100819 - DNA, 576 bp, Homo sapiens
  misc_feature: GYAE6OF02FRSYU.23.37.D04.1.454.CMB.1.raw
  modified_base (210)..(210): a, c, t, g, unknown or other
  misc_feature (210)..(210): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
tcagacgcgagtatcacgaccggtgctcgatttagtagcatactggttggggtttggggaggaactgctcaggttaggacccagagggaaccatcggaagccccaacgctcagcttctcttcctcctgctactctggctcccagagaccaccggagaaattggtgttgacacagtctccagccaccctgtctttgtccccaggggaaagngccaccctctcttgcagggccagtcaagacattagaactacttagcctggtaaccaacagaagcctggccaggcncccaggctgctcatcgtatgatgcatccagcacgggccacnggcatcccagtccaggttcagtcggcagtgggctgggacngtactcacgtctcaccatcccgcatacccgagcncgtgaagtacgtttgtaccgtttaattctagtactaacacgttaccacgtcgaccttccgtacgtaggtaccgtacggtaccgaacgggtaccgaaaggtcgaaagtaccgaacggtactcgacggtctacggactaaccgtatcgtcgttcttaccactccttacccgcctaacg

SEQ ID NO: 100820 - DNA, 686 bp, Homo sapiens
  misc_feature: GYAE6OF02IL0YO.23.37.D04.1.454.CMB.1.raw
tcagacgcgagtatcacgaccggtgctcgatttagtagcatactgttggggtttgggggaggaactgctcagttaggacccagagggaaccatggaagccccagctcagcttctcttcctcctgctactctggctccagagaccacggacgaaattgtgttgacacagtctccagcccaccctgtctttcgtccccgaggggaaagacgccaccctctcttgcgagggccagtcaagacattacggaactacttagcctggtaccaacagaagcctggccaggcctccaggctcgctcatctatgatgacactccgaggcgacggccacgtcggccacgtcccgagtccgaggttcaggtcggcgtaggttcgggtacgtacggggtacaaggtacttcacctctaccacctcgtaccgcacgtacctacggacgtcgtagtaacgttcgtttacggtacggttttactacgttcgtaaccgtaaacctaaccgttaaccctaacgtcgtccctttacggtccgtttacgggtaccgttaccgggtaaccggtaacgggaaccgttaaaggggttaacggaaacgttaaccgtaaacggtacccgttagggttaccgtacgtccgaacctaaccgttacgtttacgttcgttaccgttacctcgtttcccttacccgaccttaacg

SEQ ID NO: 100821 - DNA, 764 bp, Homo sapiens
  misc_feature: GYAE6OF02JO1EI.23.37.D04.1.454.CMB.1.raw
  modified_base (259)..(259): a, c, t, g, unknown or other
  misc_feature (259)..(259): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaacttgtgttgacacagtctccagccacctgtcttgtcccagggaacagccacctctcttgcgacgggccagtcaagacattacggactactacgacctggtaccaanagacgctgccaggctccaggctgctcactctagtgactcgcacgtccagtcgacggtccaggttcgctacgtcccaggtcctaggttacaggtcgacgtaggttcgggtcagggtacctacgtacgttccactttccgacacccggttaatcccgacgtaccggtacctaacgggacccgtacggttaacgtaaccggttaacggttttccggtaaaccgggtttttaacccttaagttcccggttaaaccgtaaaacccggttaaaccgttaacccgttaaccggtttcggtacccccgttcggtttaccggttaacgggtcccggttttaaccgggacccggttaaaacgggtaccgttaaaccggggttaacggtaaaccgtaccggtttaaaacgtacccgttagggtaccgttccggtttacacccggtaaccgttaacgttaccggtttacgttcccgttaaccgttaccgttacccggtttaccccgacgtttaacgg

SEQ ID NO: 100822 - DNA, 734 bp, Homo sapiens
  misc_feature: GYAE6OF02JM6OQ.23.37.D04.1.454.CMB.1.raw
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagacgcgagtatcacgaccggtgctcgatttagtagcatactgttgggtttgggggagggaacgtgctcagttaggacccagagggaaccatggaagcccagctcagcttctcttcctcctgctactctggctcccagagaccaccggagaaattgtgttgacacagtctccagccaccctgtcctttgtccccaggggaaagagccaccctctcttgcaggccagtcaagacagttagactactanctgtacaacngaacnctggccaggctcccaggctgctacactcgtatggatcgacactccgaagccggaacggacctaccggtggacctaactcccgaagccgtaacggttcgacgttggctaggtgggtcgtacgggacaacggtcttaccgtaaccctgttacccaacgtacgtacccgctaaccggaccgttaacggacgttaccccgtaacgtaaccggttacgttttcgggttaaccggttttacgttaaccgttacgttaaccgtaaaaccgtaaccggttaacccgtaaaccgttccgggtaacccgttccggttaaccgttccgggttaacgggtttacccggtaccggtaaccggggaaccgttaacggggtaaaccggtaaaccgtaccgtaaaacgtaccgttacgtaccggtcgtacgacgtacccgtacttcgttaccgttcttccgtacgttaccttcccgtaccgtaacg

SEQ ID NO: 100823 - DNA, 749 bp, Homo sapiens
  misc_feature: GYAE6OF02JENDN.23.37.D04.1.454.CMB.1.raw
  modified_base (202)..(202): a, c, t, g, unknown or other
  misc_feature (202)..(202): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccaggggaaanagtcaccctctcttgcagggccagtcaagacattaggaactacttagcctggtaccaacagaagcctgccaggcctccaggctgctcatctatgatgacatccagctacgggccacgtggaccacgtccccagtcccaggttacacggtggacacggtttcggggtcctacgggggaacacggtacctttacgacgttcctaccacccgtaactcccggacctaaccggtcccttaacgacggtacccttacgggtaaaccgttacggttttacggtaccggtttttaacgttaacccgttaccggttaaccaaacccgtaaccgttaacccgtaaaccgtttccggaaccccgtttacccgtttccggtttacgggacccgggtttaccggtaaccggtaacggggtaacccgtaaaggggtaacggtaaaacgttaccgaaaaccggtacccgttagggtaccgggtaccgtaccgaaccgtaacccgtaagttccggttacgttaccgtttacccaagtttccccgttaccctacccgttaacc

SEQ ID NO: 100824 - DNA, 873 bp, Homo sapiens
  misc_feature: GYAE6OF02HW3E8.23.37.D04.1.454.CMB.1.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtcctccagcccaccctgttctttcgtccccgaggggaaancgccaccctctctgcagggccagtcaagactattaggaactacttacgcctggtaaccaanagaagccgtaggccaggtcctcccgagggcctacggcctactattctaatcggtatcgctacgtcccgaaggccgaacgggcccacggtcgaccacgtcccctaggaccgtaagggttcaggtcgggactaggggtcgggtcgtagggactacggtaccgtttaccacctaccgtccaacccgtagtaccccgtacgtaacggtacccgttaacggaccggtacccgtaaggtaaaccggtttaaccgtttcgggttaaccggtttttaacttacggttaaccgttaaacccgtaaaacccgttaaacccgggttaaaccccttaaacgggttcccgggtaacccccgttttacccgggtttaccggtttacccggggtaacccgggtttaccccgggaaccggggttaaaaccgggggtaaccccggttaaaacgggggtaaacggtaaaaacccgttaacccgggtaaaaaacccgggttaacgttccgggggttaaccggtaaccgtaaccgggtaacccgtaacccgtaacggtttcccgtttacgttacccggtttaccctacccgttttaccccgttaccccccggtacttaacccgg

SEQ ID NO: 100825 - DNA, 708 bp, Homo sapiens
  misc_feature: GYAE6OF02GWUHX.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgccccaggggaangccaccctctcttgcagggccagtcaagacattaggaactacttagccgtaggtaccaacagaacgcctggccaggcctcccgaggcctgctcatctatgatcgcatccagcgacgggccacgtggacactcccgagcgtaggttcaggtggcgtaggtgggtcgtaggggacacgtacttacaccgttcctaccacctacgtcccgaccgtacgtacccgtaaggcgtacccgtaaggtaaacgttccgttttacgggtaccggtttttaacgttaccgttacggtaaacctaaacccggtaaaccgttcccgaaacgttcccggtacccgttacccggttacgggttaccgggttaccgggtacccgggaaacccggtaaacgggggaacccgtaaaggggtaaccgtaaaacgtaccgaaaacggtactttggggacgtacccgtaggaaccctacgtacgttcgttacgttccttacacccgtttaccgttccccgataccgg

SEQ ID NO: 100826 - DNA, 713 bp, Homo sapiens
  misc_feature: GYAE6OF02GE3ME.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccacctgtctttgtccccaggggaaagngccacctctcttgcagggccagtcaagacattaggaactacttagcctggtaccaacagaacgcctggccaggcctcccaggctgctcatctatgatgcatccaggcacgggcctacgtcggccactcccgagcccgtaggttcaggtggcaggttcgggtcgtagggactacgtcttactactcctaccacctacgtcccgacgaacgcccttaaggacgtacccgttaggtaaacgttccgttttacgggttaccgttttaacttaccggttacgttaacctaaacccgtaaacgttaacccgaaaccgttccggtacccttacccggtttacggttaccgggtacccgtttccggggaacccgtaaacggggtaaccgtaaagggtaacggtaaaactaaccgaaacgttaccggtgggtaccgggtaccgtacggtaacccgtaacttacgttacgttaccgttacctttccgtaacctttccccgtttaccccgattaacccgg

SEQ ID NO: 100827 - DNA, 766 bp, Homo sapiens
  misc_feature: GYAE6OF02FGREB.23.37.D04.1.454.CMB.1.raw
  modified_base (211)..(211): a, c, t, g, unknown or other
  misc_feature (211)..(211): n is a, c, g, or t
tcagacgcgagtatcacgaccggtgctcgatttagtagcatactgttgggtttgggggaggaactgctcagttaggacccagaggggaaccatggaagccccagctcagcttctcttcctcctgctactctggctcccagagaccaccggagaaattgtgttgacacagtctccagcccaccctgttctttcgtccccgaagggggaaagngcccaccctctcttgcagggccagtcaagacagttaggaacttacttagcctggtaccaacagaacgcctggccaggctcccaggctgcctcatctagtgatgacatccgaagcacgggccacgtcggcctagtccccaagcccgtaggttccgaggttcggacgtagggtcggggttccggtaggggtaaccacggttaccttaccgtacccttacccgtaccgaaaccccgtacgttccccggactaccggtacccttaacgggcgtacccccggttaaaggtaaccggtttaccgtttttacgggtacccggtttttaaatttaccgttcggttaaaccctaaacccggttaaaccggtaacccctaaccggttccggtacccctttaccggttccggttagggttaccccggttaccggggaacccggaaacggggtaaccgaaagggttacggaaaacttaccggaaaaccggtcgtacggtcggtaccttaggaccctaaccgtcgttcgtttaccgttcttacgactttcccccgtacgtaccctacg

SEQ ID NO: 100828 - DNA, 619 bp, Homo sapiens
  misc_feature: GYAE6OF02H5962.23.37.D04.1.454.CMB.1.raw
  modified_base (204)..(204): a, c, t, g, unknown or other
  misc_feature (204)..(204): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagacccaccggagaaattgtgttgacacagtctccagccaccctgtctttgtccccaggggaaanagccaccctctcttgcagggccagtcaagacattaggaactacttagcctggtaccaacagaacgcctggccaggcctcccaggctcgctcatctatgatgcatccagcgagggccactggcactcccagccaggttcaggtggctaggtggtctgggactagcttcactctcaccacgtccgacagaccctagacgtcctagaacgttacgttttggtacggtttttaacttacgtacgttaaccaaacctaaccgttaacccaaccgtcggtacccttaccggttccgttacggtacggtttccggaccgtaagggtaacccaagggtacgaaaagtacgaaaccgtacgtacggtacggtactcggacctaccgtacttcgttcgttcttccacgttcccttccccgctacg

SEQ ID NO: 100829 - DNA, 691 bp, Homo sapiens
  misc_feature: GYAE6OF02IGWE7.23.37.D04.1.454.CMB.1.raw
  modified_base (277)..(277): a, c, t, g, unknown or other
  misc_feature (277)..(277): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctgctcccagagaccaccagagaaattgtgttgacacagtctccagccctaccctgtctttcgtccccaggggaaagacgcccaccctctcttgcagggccagtcaagacattaacggaactacttacgcctaggtaaccaacagaacncctaggaccaggcctaccccgaagggcctcgcctacactactaatgacgtgactactccagcgaacgggccgaactcggacacctaccggacgaccgtacggttccaggttggacgtaagggtgggtcgtaggggaacacggtacttactactcctacgaacctacgtccgacacggtacctaaggacgtacctaggaaacgttactttacgggtaacggttttacttacgtacgtaaacctaaaccaaaccgttaacccaacggttaccggacccttccgggttactttacgggtaccgttacccggaaccgaaaccggggtacccgtaaaggtaaaccgtaaacaaccgtaaacgacgtaggtacgactcggaaccactacgtcttgtacctcgtacttcccgtcccgaacc

SEQ ID NO: 100830 - DNA, 248 bp, Homo sapiens
  misc_feature: GYAE6OF02FNA85.23.37.D04.1.454.CMB.1.raw
  modified_base (243)..(248): a, c, t, g, unknown or other
  misc_feature (243)..(248): n is a, c, g, or t
tcagacgcgagtatcacgaccggtgctcgatttagtagcatactgttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttgggctgcctggtcaaggactacttccatactcgcgtctgagcgggctggcaaggcgcatagnnnnnn

SEQ ID NO: 100831 - DNA, 700 bp, Homo sapiens
  misc_feature: GYAE6OF02FZX0T.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccagggggaaagcgccaccctctcttgcgagggccagtcaagacattaggaactacttagcctggtaccaacagaacgcctggccaggcctcccgaggcctgctcatctatgatgcatccagcgacgggcccacgtcggcactccccagccaggttccaaggtcggacgtaggtggggtcgtgggacgagtacctcgtactctaccaccactcccgacacgcctaacgacgcccgtagaacggttacttttacggtaccggttttaacttacgttagttaaccctaaacgtaaacccgttaacccgaaccgttccgggtaccccttccgggtttaccgtttaccgggtacccggttttaccggggtaacccggtaaaggggtacccgtaaagggttaacggtaaaaccgtaacgaaaccggtaacgttcgggtacggtaccgtacgtaccaaccgttacgttccgttacgttacccttacgttaccttacccgtttccccgacttacc

SEQ ID NO: 100832 - DNA, 675 bp, Homo sapiens
  misc_feature: GYAE6OF02F907E.23.37.D04.1.454.CMB.1.raw
  modified_base (314)..(314): a, c, t, g, unknown or other
  misc_feature (314)..(314): n is a, c, g, or t
  modified_base (604)..(604): a, c, t, g, unknown or other
  misc_feature (604)..(604): n is a, c, g, or t
  modified_base (618)..(618): a, c, t, g, unknown or other
  misc_feature (618)..(618): n is a, c, g, or t
tcagacgcgagtatcacgaccggtgctcgatttagtagcatactgttgggtttgggggaggaactgctcagttagggacccagagggaaccatggaagccccagctcagcttctcttcctcctgctactctggctcccagagaccaccggagaaattgtgttgacacagtctccagccacctgtctttcgtccccaggggaaacagcccacccttctcgttgcgaggccagtcaagacctattacggaactactagcctaggtaccaacgagaacgcctggtccaggtctcccgaggctacgctcagtctagtnatgctactccgagacacggggccacgttcgacacgtcccagtaccgtaggttacaggtcgacgtacgggtgggtccggtagggacaagtacccttacgaccgttccaccgaaccctcgtccgactacgtaccgtaacggcgtaccctaggtaaacttacgtttacggttacggtttacttacgtaccgtaactaaccgtaaccgtaaccgtacgtcggtaccctaccgttcgttacggtaccgtacggtacgtaacggtacgttaacgtacggtaaacacgtaaacggtntacggtacggtacncggtaccacgttacgttcctacggtttccttagaccctttaccgtacccgtataccg

SEQ ID NO: 100833 - DNA, 657 bp, Homo sapiens
  misc_feature: GYAE6OF02JUPWR.23.37.D04.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttgtccccgaggggaaagngccaccctctcttgcagggccagtcaagactagttaggaactacttagcctggtaccaacgagaacgcctggccaggcctcccaggctgctcattctatgatgacntccagcgagggccacgtcggctactcccgacgcccgtaggttaccgaggtcggacgtagggttcgggtcgtacggggaactacggtacctttacgaaccttccgtaccaccgtacgtcccgataccggccttaacgggctacccgtagaaacgttccgtttggtaaccggttttataccgtgtaacctaaacgtaacccggtaccaaccgttgtcccgttccgtggtttacggccgttccgaaccggtacggtaaccgtaagggttcgaaagtaccctaaaggtacttggacggtcgtacgaccgtacctagttctcgttacgtcctaacgtcccgtaccctatacg

SEQ ID NO: 100834 - DNA, 795 bp, Homo sapiens
  misc_feature: GYAE6OF02IIV31.23.37.D04.1.454.CMB.1.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccgaggggaaangccaccctctcttgcgagggccagtacaagacattaggaactacttagcctggtaccaacagaagcctggccaggcctaccgnggctcgctcatctatgatgcatccngcgaagggccctacgtcggactaccgtaccgacgtaccgtaaggttccgaggtcggacggtaggtttcgggtaccggtagggtaaccgtaaggttacccttacctaaccgttacccctacctaacccgtaaccggtccccgggtaacaccggttaacccgttaacgggaacccgtacccgtaaagggttaacgtttaaccggtttacgggtttaccgtttttaacgttaaccgttacggttaaccctaaaaccggttaacccgttaaacccggtaacgttcccgggtacccgtacccgggttttaccggttaggtttaacccggggtccggtaaacccgggtaacgggtaaaccgggtaacggggttaaacggtaaacgtaaccgtaaaccgttaggtcggttacggtaaccgtccgaaccgtaaccgttaccgttacgtttcgttaccttaccttccgttacccccttccggaccttaaccg

SEQ ID NO: 100835 - DNA, 706 bp, Homo sapiens
  misc_feature: GYAE6OF02HIOC8.23.37.D04.1.454.CMB.1.raw
  modified_base (220)..(220): a, c, t, g, unknown or other
  misc_feature (220)..(220): n is a, c, g, or t
  modified_base (277)..(277): a, c, t, g, unknown or other
  misc_feature (277)..(277): n is a, c, g, or t
  modified_base (646)..(646): a, c, t, g, unknown or other
  misc_feature (646)..(646): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagacgaccaccggagaaattgtgttgacacagtctaccagccacccttgtctttcgccccgaaggggaaagcgccacccttntcgttgcgacgggccaggtacaagactaagtacggaactactagcctaggtaccaanagaacgccgtcggacaggcctacccgaggtctcgaccgtctatcttaagcgtagtacgtccaacgtcccaaggccgaacggggaccctacgtcgggaccaaccgttccccgaagttccggacggttccgaggttcggacgtacggggtcgggttacgtaccggggaactacgtacctttaccggactttaccgtaacccgcccttaaacgtccccggtacgtacgaccgttacgaccggtaccgtaggttaacgtacgttttacgggtacgttttaacgtactcggttaaccgaaccgtaactaccgtaacgtcggtacctcgtcgtacgggtaccgtcggaccgtaacgacgtacggtagaacgtaanaaccgtagtcgtcggtgtcgacgacctagtcctgttcctacgttacgtccttccgctacg

SEQ ID NO: 100836 - DNA, 836 bp, Homo sapiens
  misc_feature: GYAE6OF02FN0DC.23.37.D04.1.454.CMB.1.raw
tcagacgcgagtatcacgaccggtgctcgatttagtagcatactgtttgggtttgggggaggaactgctcagttaggacccagagggaaccatggaagccccagctcagcttctcttcctcctgcttactctggcctcccagacgaccgaccggaagaattgtgttgacacacgtctccagccacccttgttcttttcgtccccgaagggggaaaacgacgcccacccttctcttcgccgagggcccagtcaagactattaggaacttacttaagtccgttaggtaacccaaacgacgaacgccgttcggaccacggtcctaccccgaggccgttcgtccttaccacttccttaagtgtatcggacacgtaccgagccgacggggacccacggtcgacctaccttaccccgacgtccggttaaggttcgtaagggtcgacgtagggttcgggtccgttaggggaccctaagtaccgtttccacctttaccgtacctaaccgtacgtccccgacgaacggtcccgtaaggaccgtcccgttaaggtaaaccggttaccggttttttacggttaccggtttttttaacgttaccgtttacggtttaaacccaaaccgttaacccggttaaccgtaaaccgttccggtcccctttaacggttttccggtaacggggttacccgttttaccgggaaccgggttaaaccgggaacggtaaacggttaaccgggtaaaacctacccgtaaaacgggaccgtttcgggtacggtccttacggaaccctacctaccgtttccggtactttccgttactaccctttcccggttacccctcttacg

SEQ ID NO: 100837 - DNA, 682 bp, Homo sapiens
  misc_feature: GYAE6OF02HLBU7.23.37.D04.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtcttcgtccccaggggaaangccaccctctcttgcagggccagtcaagacattagaactactagcctggtaccaanagaagcctggccaggcctccaggctgctcatctangatgacatccagcacgggccacgtggcactcccagccctaggttccaggtggcaggtcgggtctgggaacaggacttcactctccaccactcgcacgcctagacgcctagaagtacgtttacgtcgtttaatacttgtaaccaacgtaaccgttacccaactcgggtacccttcccgggttagttaccgggtaacccggtttccgggaccccggaaacggggtacccgtaaacggggttacgaaaaacggtacccgtaaaaccggtaacggttacggtccgggtaacgtacccggtaacccgaaccccgttaagtttcccggttaccgggtttacccttacccgttaaccggttttccccgtttaccccccgggtaccctttaaccgg

SEQ ID NO: 100838 - DNA, 646 bp, Homo sapiens
  misc_feature: GYAE6OF02GO59B.23.37.D04.1.454.CMB.1.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtcccccgaggggaaagagccaccctctcttgcagggccagtcaagacattaggaactacttagcctaggtaccaacagaacgcctggccaggctcccaggctgctcatctatgatgcatccagcgagggccacgtggccacgtccccagtccaggttcagtcggcgaggtgggtctgggacnggtactcacttcncaccacgtccgacacgacctaggacgtcctaggtaacgttacgtttcggtacggttttattaccgtgttaacaaaccgtaaccgtaacctaacgtcggtacccttccggttcgttcggtaccgttaccgggaccgtaacggggaccgaaagggtacggaaacgtaacgaaaaccgtacgttaggtacggtcgttacgaccgtaacccgtagttaccgttcggttaccttaccgtacgtttccccgtttacccgaccttaacg

SEQ ID NO: 100839 - DNA, 644 bp, Homo sapiens
  misc_feature: GYAE6OF02HH6LI.23.37.D04.1.454.CMB.1.raw
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctccagagaccaccggagaaattgtgttgacacagtctcagccaccctgtctttgtccccgagggaaagagccaccctctcttgcaggccagtccaagacattaggactacttgcctgtaccaanagaacncgtaggccaggcctccgaggctgctcatctagnatgctanccaggtcagggccagtcgactactccaggcctaaggttcagggcgacggtggtcgggtcggttcggacacgtacgttccacttccgcaacctcgtccgacagcctagaccgacgtacgagtccgtttagtaccgtttagttacttagtacctacgtaaccgtacaaccgtcgtaccgtccgttcgttacggtacgtaccggtaccggaacggtaccgttaagggtaacgtaacgttaacgaaaccgtacgttacgggtcggtacgttaccgacgtaacccgttacgttaccgttcgtttaccgttaaccgtacctttacccggttaccctaccgttaccg

SEQ ID NO: 100840 - DNA, 662 bp, Homo sapiens
  misc_feature: GYAE6OF02HA81S.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattagaactacttagcctggtaccaacagaacgcctggccaggcctcccgaggctgctcatctatgatgcatccagcgagggccacgtcggcactcccgagccctaggttccaggtcggacaggtcgggtcgtagggactaggtaccttcgaccttctaccgaaccctactcccgacacgtcccgtaaggaccgtccgtaggtaaacgtacgttttcggtaccggttttaattcgttagttaaccaaaccgttaaccgtaacctaacgtcggtccccttcggtacgtttaccggaccgtttccggaaccgaacgggtaccgtaagggtacggaaaacgttccgaaaacggtaccgttaggtaccgggactacggacctaacctacgttcgtcggttaccttcctaacttcccgttaccccgattaacg

SEQ ID NO: 100841 - DNA, 622 bp, Homo sapiens
  misc_feature: GYAE6OF02GIXFJ.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcacgggcccacgtcggcacgtccccagcccgaggttcgaggtcggacaggtgggtcgtggggacagtaccgttcaccttcgtacacccgactcccggcacgtccctaagcgccgtagaacgtactttggtcggtttattacgtcgtaccaaaccgtaacctaacctaacgtccgtacccttccgtacggttacggtaccggttccggaccggaacgggtacctaaagggtaggaaactacccggaaacgtacgtaggtcggtcacggtaccacctacgttctacgttccttactacgttcccttaccggctacg

SEQ ID NO: 100842 - DNA, 648 bp, Homo sapiens
  misc_feature: GYAE6OF02HRXKI.23.37.D04.1.454.CMB.1.raw
  modified_base (206)..(206): a, c, t, g, unknown or other
  misc_feature (206)..(206): n is a, c, g, or t
  modified_base (640)..(640): a, c, t, g, unknown or other
  misc_feature (640)..(640): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagagaccaccggagaaattgtgttgacacagtctccagcccaccctgtctttcgtccccaggggaaangccaccctctcttgcagggccagtcaagacattaggaactacttagcctaggtaccaacagaacgcctggccaggcctccgaggctgctcatctatgatgcatccagcagggccacgtcggacactccgacgccgtaggttcagtcggcgtagggtcgggtcgtacggggactacggtaccttccgacttccgtcctaaccctacgtcccgacctaacggtcccgtaaggacccgtctaaacgggtacgttacgttttttacgggtaattacgttacgtaacctaaacgtaaccgttaccaacgtccgtcccttccggttctcgggtaccgttacggacccgtaagggacccgtaaagtcgaaactaacgaaacgtgtcgtagaccgagtccctaactgttcgtctttccgttacaccggttcccttaacccgnttactacg

SEQ ID NO: 100843 - DNA, 893 bp, Homo sapiens
  misc_feature: GYAE6OF02IUD1R.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccacggagaaattgtgttgacacagtctccagccacctgtctttcgtaccccgaggggaaacgacgcctaccctctacttgcgagggcccagtacaagactaagttaaggtaacctaacttacggccgttacggtaaccaaacgaagaacgccgtcggaccgaacggtcctcccgaaggtccgtgccgttacacttactatacgtatgactactaccgagtaccggaccgggtaccacggtcggtaccaccgtacccacggtacccgtaggttacgacggttcggacggtacgggttacgggtaccggtagggtactaacgtaccttacgacctccgtaaccaccgacgttcccgaacggtacccgtaacggtaacggtaccggtaccgtaacgggttaaaccggttaccgtttacgggttaccggtttttaaacgtaccggttaccggttaaacccgtaaaccgtaaaccccggttaaccgtaaccggttaacccggggttccccctttaaccgggtttccggttttaaacccggggttaccccggtttaacccggggaaaccgggttaaacccgggtaccgggtttaaaacgggtaaacgggttaaaacctaaaccggggtaaacccgttaacggttccgggttaaccgggtaccgttaacccggaccgttaacctaaccggttaccgttttaccggttacctttacccgttaaccggttttccccccttaccgggtaccctttaaccgg

SEQ ID NO: 100844 - DNA, 822 bp, Homo sapiens
  misc_feature: GYAE6OF02ITX5J.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggcctcccagagaccaccggagaaattgtgttgacacagtctccagccaccctgtctttgtccccaggggaanagccaccctctcttgcagggccagtacaagactagttacggaactacgttacgccgttaggtaacccaaacagaacgcctaggaccgaggcctcccgacggcctgacctcgattccttagtagtacgtgccaccgtcccgaaggccggaacggggacccaccgtcgggccaaccttaccccgacgtaccgttacggttacgacgggttcggaccgtaggggtcggggttacggtacggggaacctacggttaccttaccgtaccgtccttaaccctaccctacggttccccgaaccgtaaccggtacccgtaaacgtaccgtacccgttacgggtaaacgtttaccgtttttacggggtaaccggttttttaacttccggttaacgttaaccgtaaaaccgttaacccggtttaacccgaacgtttcccgggtacccctttacccgggtttaccgtttacgggtacccggtttaccggggaaccggtaaacgggtaaccggtaaagggtaacgggtaaaactacggaaaacggttacgtaggttaccgggacgttacacccgtaaccgtgtttaccgttccgtttacttaccgtaccgtttacccgttcccgacttacg

SEQ ID NO: 100845 - DNA, 886 bp, Homo sapiens
  misc_feature: GYAE6OF02G10W6.23.37.D04.1.454.CMB.1.raw
tcagacgcgagtatcacgaccggtgctcgatttagtagcatactgttgggtttgggggaggaacgtgctcgagttaggacccacgagggaaccatggaagtccccagcgtcagctctcttcctcctgctactctggctccagagaccgaccggtaggaattgtgttgacgtacagtcgtcctagccgaccctcgtactttcgtcccccgaaggggtaaagcgacccacccgttcgtacttcgacggagggccctaggttccaaagacctaaggttacggtaacgtaacgttacgtaccgttcggtaaccaaaccgaaggaacgtcccgttacggggtaccctaacggttccgttaccccgtaagggttccgtacgtcctactaacgttaccgtaaccgtggtaacgttccgggacgtaccgttaccgaaggtccggtaccggaccgtacgtacggtaccgactaccccgagtaccgaacggttcaggtaacgtacgagggttcggtacgtagggactacgtacgttactactccgtaaccgaccgtacgtacccgagaaccgtaccgtaacggtacgtaacccttacgtaacgttacgtttacggttaccgtttaaaagttccgaacgtaacctaaccgtaaacgaaccgtacgttaccggcccgttacgttaccgttacggttacccggtttacgggaacccgttaaacgggtaccgtttaaacgggtacggtaaaaaccgtaacgtaaaacggtaccgtttcggtaacgggtaaccccgtttaagggaaccccgtaaccggttaacgttttaacccgggtacgtttaaacccgtttacccgtaacccgggttaacccttttacccccgggaacttttaacccgg

SEQ ID NO: 100846 - DNA, 875 bp, Homo sapiens
  misc_feature: GYAE6OF02G5TBP.23.37.D04.1.454.CMB.1.raw
  modified_base (206)..(206): a, c, t, g, unknown or other
  misc_feature (206)..(206): n is a, c, g, or t
  modified_base (863)..(863): a, c, t, g, unknown or other
  misc_feature (863)..(863): n is a, c, g, or t
tcagacgcgagtatcacgaccggtgctcgatttagtagcatactgttggggtttgggggaggaactgctcagttaggacccagagggaaccatggaagccccagctcagcttctcttcctcctgctactctggctcccagagaccaccggagaaattgtgttgacacagtctccagcccacctgtctttgtccccgaaggggaaancgccaccctctcttgcagggccagtcaagacagttaagactacgttagcctaggtaccaacagaagcctggccagcctacccaggctgcctatactctatcgaatcgctataccgacggtacggacggggccctacggtcgggtacctaacccggttccccgtaaccggcccggttaacggttttaccgaaacggggttcgggtaccggttacgggggtttacggggtaccgggtttaccggggaaaccgaacgggtttaaccctttacgggtaacccctttccgttaaccgaaccccggtacgtacccccgtacgtaaccgttacccggtaaacggtaccggttaaccccgtaggtaaaaccccggttacgttttacggggtaccgttttttaaaccgttaccgttaacggttaaacccgtaaaacttaaccccggttaaccgtaacccgttaccgggtaccccgttacccggtacggttttacccggggtaacccgggtttaaccggaacccggggaaacggtaacccgtaaggggggttaaacctaaaccgttaacggaaaccgttagggtaccgtacgggtccctaaccggttaccggaaccctaggttcccgttagtttacccgttaccttacggtttccccggttaccccnccggtttaaccg

SEQ ID NO: 100847 - DNA, 742 bp, Homo sapiens
  misc_feature: GYAE6OF02HLXMC.23.37.D04.1.454.CMB.1.raw
tcagacgcgagtatcacgaccggtgctcgatttagtagcatactgttgggtttgggggaggaactgctcagttaggacccagaggggaaccatggaagccccagctcagcttctcttcctcctgctactctggctccagagaccaccggagaattgtgttgacacagtctccgagcccacccttgtccttttcgtaccccgagggggaaacacgccacccgttctcttgcacggtccagtacaagacattaggaactacttacgccttggtaccaacagaacgcctggccaggcctcccaggcctcctcatctatgtactaccttccgagtacgggtacaactggacactccccagccccgtctttcagggtcggtcagggttcgggtccgtaggggaacctacggtcttaccgacttccgtaccaccctattcccaacctacggtcctaacggaccgtaccttaggtaaacgtctttttacgacgttaggttttaacttaccgtttcgtacgtacggtaacctaaccggttaacgtaaacgggttccgtacctaccgttaaacgtttactttaacccgttacccggtttccggttccccgtaaagggtaaccccgttaaagggttcggtaaactaacgtaaccggtaaaccgtaacgtttcggtaccggaccttacgaacctacccgtagtacccttacggttaccttaccgttaccttcccgttacccgaccctttaacg

SEQ ID NO: 100848 - DNA, 724 bp, Homo sapiens
  misc_feature: GYAE6OF02IM2OC.23.37.D04.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (340)..(340): a, c, t, g, unknown or other
  misc_feature (340)..(340): n is a, c, g, or t
  modified_base (683)..(683): a, c, t, g, unknown or other
  misc_feature (683)..(683): n is a, c, g, or t
tcagacgcgagtatcacgaccggtgctcgatttagtagcatactgttggggtttgggggaggaactgctcagttaggacccagagggaaccatggaagccccagctcagcttctcttcctcctgctactctggcctcccagagaccaccggaagaaattggtgttgacacagtctccagccacctgttctttcgtaccccgaggggaaancgccacctctcttncgacgggccagcaagacagttagaactactacgcctacggtaccaanagaacgccgtggaccgacggcctacccgaggtacttcgccttacaactctagtcgatgacctataccgngaccgacggcctagtcggactacgtcccacggtcgtaggttcgaggtcgtacgtacgggttcgggtacgttcggggaactacgtaccgttacacttccgtaccaacccgtacttccggcctaaggtcccgttagaccgtacccgtagttaaaccggttctttacgggttaccgttttacgtaccttggtaaccttaaacctaacccggtaaacctacggtacctcccggttaccttcgggttaacgggtacccgttacccgggtaacggaccggggttaaactaacggggtaagtaaaccgtaacgaaaccggtacgtcggtacgtcggtaccgactacggtnttaccggtctttacgacctttaccggtccttaccgcctaac

SEQ ID NO: 100849 - DNA, 726 bp, Homo sapiens
  misc_feature: GYAE6OF02FYVXE.23.37.D04.1.454.CMB.1.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaatgtgttgacacagtctccagccaccctgtctttgtccccgaggggaaagngccaccctctcttgcagggccagtcaagacattaggaactactacgctggaccaacagaanccgtcggccacggctcccaggctgctctatctatgatcgctactccgagccgacggaccacgtggccacgtccccgaacgccgaggttacgacggtcggtacgtaggggttcgggtccggtacgggaaccgtaacgtccgttacctaacgttccctaccgtaaccgtcctcccggaccgacgtaccgtaagaccggtactaggtaaacgttccggtttaggttaccggtttttaaattaccggttacgttaaacccgaaacgttaacccggtaaaccctaaccgttccggtaccctttacccgggttgttaccgggtacccgtttacccgggaacggtaacccgggggtaaccgtaagggtaaccggtaaaccttaacggaaacccggtattcgggtaccggtacgaccgtaccgactacggttcctaggttaccttcgacctttaccgtccaccttaacg

SEQ ID NO: 100850 - DNA, 1054 bp, Homo sapiens
  misc_feature: GYAE6OF02JMUQK.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggcctcccagagaccaccggagaaattgtgttgacacagtctccagccaccctgtctttgtacccgaggggaaagacgccacccttcgtccttgccgacgggcctaggtacaaacgtactaagttaacgggaaaccttacttacgccgttacggtaacccaaacgaacggaacggtcccgtaggacccaaggtccctacccgaggtcctacgccttctactacttaagtcgtagtcgtaacctcgtacccgaggaccggtaccgggtacccctacggttacggcccgtaccctaacccggacggtaccccgtacgggtttaccgaacgggttcggacccggtacggggtttaccggggttacggtaaccgggggtaacctaacgggtttaccgttaccccgttaaccgtttaccccgtaacccggtaaccccttaccgggtttacccccgtaccggacccgggttaacccggtttaaacggaaccccggttaccccgggttaacggttaaaccgggttttaaaccccgttttacggggttttaaacccggtttttaacgtttttaaacccggttaaccggttaaaacccgtttaaaaccccgggttaaaacccctttaacccggaacccgggttttaccgggttacccccgtttacccgggttttaccgggttttacccggggttaaacccccggttttcccgggggaaaacccgggttaaacccggggtaaacccgggttaaacgggttaaacccgggtttaaaacaaacccggggttaaaccggttaccgggtttaagggtacccgggtcccgttaaaccgggaacccgttaccccgttaaggttttacccccgtttgggttaaccccgttttagtaacccccgggtttttaccccggttcccgttaaaccccttaacccgg

SEQ ID NO: 100851 - DNA, 773 bp, Homo sapiens
  misc_feature: GYAE6OF02JOIS2.23.37.D04.1.454.CMB.1.raw
  modified_base (206)..(206): a, c, t, g, unknown or other
  misc_feature (206)..(206): n is a, c, g, or t
tcagacgcgagtatcacgaccggtgctcgatttagtagcatactgttgggtttgggggtagggaacgtgctcagttaggacccagagggaaccatggaagccccagctcagcttctcttcctcctgctactctggctcccagagacccaccggagaattgtgttgacacagtctccacgccaccctgtcttcgtccccaggggaanacgccaccctctctgcgacggccagtacaagacaacgttaggaaccttacttagccctaggtacccaacgagaacggcctaggcccaaggcctacccgagggcctagcctcgaattctagtcgagtcgcactccgaaggccgtaccgggacctaccggtggacccaccgttaccccgaagtccccgtagggtttacccgagggttccggaaccgtgggggtttagggtcccggtaacggggaacctaacggtacctttacccgaacctcccggtaccctaacccggtaaccccgtccggtaaccgtaaccgtacccgtaacggtaaccgtcctaagggtaaaccgttacggttttaccggttacggtttaactttaccgttacggtaacctaaacgtaaacccggtacctaacggtccgtaccgtcccgttagtaccggtaccgttcggaaccgacgggtaccgaaggttaacgtaagaaccgttaacgacgttacgggtctcgggtacacgaccctacgttcttaccggtacttacctaacggttcccctttaccggacccttacg

SEQ ID NO: 100852 - DNA, 781 bp, Homo sapiens
  misc_feature: GYAE6OF02HQT07.23.37.D04.1.454.CMB.1.raw
  modified_base (218)..(218): a, c, t, g, unknown or other
  misc_feature (218)..(218): n is a, c, g, or t
  modified_base (379)..(379): a, c, t, g, unknown or other
  misc_feature (379)..(379): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccgaccggagtaaattgtgttagacacagtcctccagccacctgtctttcgtacccgaggggaagacgccaccctntctgcgacgggccagtacaagtactaagttacggaactacttacgacctaggtaaccaagagaacgcctgggaccacgggcctacccgaggtctcgtctacattactagtacgatcgactactaccgagcgtacgggacctaacgtcggaccaccgtaccngtaccgtaggtcaggtcggcgtagggtttggcggtaggaacgtacgtaccgttacaccgtacctccaacctagtaccccgagtacgtaccgtaggtaccgaccgttaacggtaacgttcgtttaacggggttatttaccttaacgttccgttaaacgtaaaccgtaacccggttaacctaacgggttacccgttacccgttacggtttaccggtaccggttaacccggttcccgggtaaaccggtaaacgggttaacgggtaaaacgggtaaacgttaaaccgtaaaccgtaaacggttacggtaccggtacggacccgtaacgacccgttaactaaccggtttcgttaccttttaacccgttacgttaccctttaaccccggttccgtttaacccaaccgg

SEQ ID NO: 100853 - DNA, 731 bp, Homo sapiens
  misc_feature: GYAE6OF02H32DM.23.37.D04.1.454.CMB.1.raw
  modified_base (168)..(168): a, c, t, g, unknown or other
  misc_feature (168)..(168): n is a, c, g, or t
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
tcagacgcgagtatcacgaccggtgctcgatttagtagcatactgttgggtttgggggaggaactgctcagttaggacccagagggaaccatggaaagccccagctcagcttctcttcctcctgctactctggctaccagacgaccaccggagaaattgtgttgaacncagtctccagccaaccctgtcttgtccccgagggaaanacgccaccctctctgcaggtccagtacaagactagttagaactacgttacgcctggtaaccaacagaacgcctggaccaggcctccgnggacctcgctacatctactgatacgcactaccgagcctaagtcggacctacggtcgtaccactcccgaacgtacccgtaacgggtttaccgaggtaccgggtacgtacggggtttcggggtccgtttaacgggggaacttaaccgggtaactttacccgactttaccctccgtaaccccacgttacccggaccgaaccgtaccgttacggaaccgtaccgtaaggtaacgttacgtttacggttaccggttttaacgttaccgtaacgttaccgaaaccgtaaaccgttaacgaaccgtaccggtaccttcccggttacgttacggtcgttaccggaccgaacgggacgtaaagtagggaaactacgaacgtacgtaggcggtacgtacgaccctacacgttagtaccggtttctacctaccttcccttacccgtac

SEQ ID NO: 100854 - DNA, 662 bp, Homo sapiens
  misc_feature: GYAE6OF02FTXU8.23.37.D04.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccgaggggaaagngccaccctctcttgcagggccagtcaagacattaggaactactagcctaggtaccaanagaagcctggccaggcctcccgaggctgctcatctatgatgcatccagcgagggaccagtcggcactcccgagcctaggttcaggtcgcgnggtcgggtctagggacagtactcactctaccactcgtcccgctacgacctaggcgtccctaaggaacgttacgtttcggttacgggttttaacttacgttcgttaaccgtaaaccgttacgtaacctaacgtccggtccttcccgttaccggttgggtacccggttcggacccggaaacggggtacccgtaaaggggtacgtaaaaccgtacgaaaccggttaacgttcggtacggtcgttaaccgccgtaaccgtagttccgttacggtttcccttaactaccggtttaccctttcccgactttaccg

SEQ ID NO: 100855 - DNA, 782 bp, Homo sapiens
  misc_feature: GYAE6OF02JLAW2.23.37.D04.1.454.CMB.1.raw
  modified_base (152)..(152): a, c, t, g, unknown or other
  misc_feature (152)..(152): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagacccaccgganaaattgtgttgacacagtctccagcccaccctgttacctttcgtaccccgaaggggaaacgacgccctacccttctcgttgcgacgggaccagtacaagtactagttaaggaacctacttagacctacggaaccaacgtaacgaacgaccgtggcctacggcctcccgaggtctcggtactactactcgtatcggactacggacactccgagaccggacggtacctcggtacgcctacctaccgacgtccgacgttacgagtcggacgtggtacgggtcgtacgggactacgtactccgtaacgttccaaccgtaccgtactacccgtacgaccgtaccgtacgtaaccggtaccgttaacgggtaagtttaaccggtttcggtttaaccggttttaacttaccggtttaacgttaaactaacccggtaaacgtacccggaaacgtacccggtttacccgttccggtttaacgtaccgggttcccggttaaacgggaccgggttaaccgggtaaccggtaaagggtaaccgtaaagaaccgttaaacggtacgtcggttaacggtccctacggaccgttactccgttacgcgtttaaccgttcacccggtttacctcccaacgtttaccg

SEQ ID NO: 100856 - DNA, 1113 bp, Homo sapiens
  misc_feature: GYAE6OF02G8Z0U.23.37.D04.1.454.CMB.1.raw
tcagacgcgagtatcacgaccggtgctcgatttagtagcatactgttgggtttggggaggaactgctcagttaggacccagagggaaccatggaagcccagctcagcttctcttcctcctgctactctggctcccagacgaccaccggagaaattgtgttcgacactacgtctccgagcccgacccttgtcctttcgtaccccgaaggggtaaacgcgaccctaacccgtctccgttcgccgacgggacccagtaccgaaacgtaccgtagtttaacggaaaccttactttacggaccgttacgggtaacccaaacgaaggaaacgtcccgttacgggaccctaacgggcccttacccgaaacgggtcctacggtaccgttaccgtaaattcgttaccgtagtaccggtacggtacctaccgttacccgaacggtcccggaaacgggggtaccccctaacggttccggggaaccttaacccggttccccgaaacggtacccccggttaaaccggggttttaccgaaagggggtttccgggtaccgtaacgggggttttacgggggttacccgtaaaccggggggtaaactaaaccggggttacctttaaaccgccccggttttaaccctacgtaaaacccccgttacggttaaaccccgaccgtacccggtaacccggtttaacggaaccggtttaacccggtagtaaacccgggtttaccgttttacggttaaccgggttttttaaacccgtttaaccgggttaacccgttttaaaccgaaaaacccgggtttaaaccccgggttaaaccgttaacccgggttaacccgggtttaacccggtttacccgttttaaccgggtttaccccgggtttaaacggggttacccccggttaaccgggtaaaacggggggttaaccccggttaaaaacggggttaacgtaaaaacccgggttttaacccgaaaaccccggggtttcggtaaaccggtttaaccgggtacccgttaaccggggtaacccctaaccggttaccgttttaacccggtacccttttacggttaacccggtttaacccgttttccccgggtttacccctacccggtttaacccg

SEQ ID NO: 100857 - DNA, 786 bp, Homo sapiens
  misc_feature: GYAE6OF02GB4NV.23.37.D04.1.454.CMB.1.raw
  modified_base (778)..(778): a, c, t, g, unknown or other
  misc_feature (778)..(778): n is a, c, g, or t
tcagacgcgagtatcacgaccggtgctcgatttagtagcatactgttgggtttggggaggaactgctcagttaggacccagagggaaccatggaagccccagctcaagcttctcttcctcctgctactctggctcccagagaccaccggagaaattgtgttgaacacagtcgtccagcctacctcgtctttcgtcccgaagggaagagccaccgtctcgttgacgaggcctagtaccgaagactagttaaggaactacgttacgcccgttggtaccaacgagaacgccgttaggaccgtacgccgtaccccgaagggtcctaggaccttccgaataccgttagttcggaacttcggtacctaacgtacccgtaggaccggaacggggtaccccacggttacgggacctaaccgtacccgtaacgaccccgtaggttttcccggaggttccgggactaacgggttcgggttaccgtagggaaccgtacgtaaccgttaccctacgttcccgtacctacccgtaaccgaccgcgtacgtaaccgtaaggtaccgtccgttacgggaacttacgtttacggttaaccgttttagttaccgtacgttaactaaaccgtaaaccgtaaccctaaggtcccgttacccgtaccgtttccgtaacgggtccggtttaccggaccgtaacggtacgaaaggtacggtaactaaaccgaaccgtacgtacgaccgggtactcggtacctaaccgtctcgtacgttcttccgtaactcccgttacccncgtaaccg

SEQ ID NO: 100858 - DNA, 631 bp, Homo sapiens
  misc_feature: GYAE6OF02FNJHI.23.37.D04.1.454.CMB.1.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (377)..(377): a, c, t, g, unknown or other
  misc_feature (377)..(377): n is a, c, g, or t
  modified_base (623)..(623): a, c, t, g, unknown or other
  misc_feature (623)..(623): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccacctgtctttgtccccaggggaaangccaccctctcttgcagggccagtcaagacattaggaactactagcctgtaccaacagagcctggccagctccgagctcgctnagtctangactgcatccagtcnggccactgcacnccgngctagtctaggcgacnggtcgtcgtgacgacgtctcgactcgtaccacgtacnccgcacgctagacgtccgtagaacgtctttgggtaccgtttagtccgttacggtaactaacccggtaacctaccggttaaaccgtcgggtaaccccttcggtttaccggtccgggttaacgttaccggacccgttaaaggggaccctaaggtacggtaacaccggtaaagtccgtagggtaccggtacctgtaacccgacccgtagtttcccgtaggttacttaccggacctttccgggttacccnggttaacc

SEQ ID NO: 100859 - DNA, 822 bp, Homo sapiens
  misc_feature: GYAE6OF02GJ0UA.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccacggagaattgtgttgacacagtctccagcccaccctgttctttcgtccccgaggggaaacgacgccaccctcttctgcgacgggccagtacaagtacagttacggaactactacgcctacggtaaccaacgaaggacgtccgtcggaccgacggtccctacccgaggaccttcgccttacacttacttacgtaggtactcgtacctaacgttaccgacggtaccggtaacgggaccctacggttcggaaccctacccgtaaccccgtacggtcccgttaaacggttcgaagggttcggtaccgtaggggtttcgggtaccgtaggggtaacaacggttaccttaccgtagttccctacggaaacccttccgtacccggaccgtaccggtacctaacgggtaaccgcgttaacggtaacgtttacggttttaccgtttaagggttttaaccttccggtaacttaacccgaaacccgttaaccgtttaacccgaacgtttaccggttcccgtttaccggtaccggtttaacgggtacccggttaccgaacgggtaaaccggaacgttaaacggacggtaaacgtaccgtaacgtcgtacgtacgtccgttaccggaacctagttaccttacgtttacggttacctaccggttaccttacccggtaccgtactttaccgg

SEQ ID NO: 100860 - DNA, 935 bp, Homo sapiens
  misc_feature: GYAE6OF02IOIFQ.23.37.D04.1.454.CMB.1.raw
  modified_base (60)..(60): a, c, t, g, unknown or other
  misc_feature (60)..(60): n is a, c, g, or t
tcagacgcgagtatcacgaccggtgctcgatttagtagcatactgttggggtttgggggnggaactgctcagttaggacccagagggaccatggaagccccagctcagcttctcttcctcctgctactctggctcccagacgaccaccggagaaattgtgttgacacagtctccagcctaccctgtctttcgtccccgaggggaacgagccaccctctcttgcgacgggccagtacaagaccgtaagtttaacggaaaccttacgttacggacccgttacgggttaacccaaacgaagggtaaacgtcccgtacggggacccaacggggtcccctaccccggtaacggggtcccttacggtcccttacctaacgttacctttaagtacggtaattacggtacctaacgttacccgaggaccggaaccgggggtacccctaccggttcgggaccctaaccgttccccggaaccggtccccggttaagggttttacgacgggttacggtacgtaacgggggtttcgggtcggtaacggggtaccacggttaccttacgaaccttcctacgtaacccgtacgtacccgtaccgtaccgtaccgttaaacggccgttaccgtaacggttaacggtttaccgttttcgggttacggtttttaacgttaccgtttacggtaaacctaaacccgtaaacccggttaacccgtaacgttccccggtaccgttaccggtttaccgtttaaccgggggttacccgttacccgggaaacccgggtaacgggaacccggtttaaaggggtaacggtaaaaccctaacgggttaaaccgtaccgtttacgggtaccggttaccggtaacgtaccgtaaccccgttagttaacccgtttcggttacccgtttaacgtcccgttaaccccggtttcccgtaacttacccg

SEQ ID NO: 100861 - DNA, 706 bp, Homo sapiens
  misc_feature: GYAE6OF02IRJUG.23.37.D04.1.454.CMB.1.raw
  modified_base (201)..(201): a, c, t, g, unknown or other
  misc_feature (201)..(201): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctaccagagaccaccggagaaattgtgttgacacagtctcagccacctgttcttcgtccccgagggaancgccaccctctcttgcgaggccagtcaagacattacggaacttacgttacgccgttacggtaaccaacagaacgcctggccaggtcctccgaggtcctgctactaactctagtacgatcgacctactccgaggccgacgggttcccaggtcgactccgtacccgagccgtaggttacgagtcggactagggttacgggtctagggacgtacgtaccttcgaaccttccgtacactacgtccgactacgctaacgcgtcgtaagtacgttaacgtttcgttaccgtttatacgtacggtaacctaacgtaaccgttaccgaaccgttccgtcccgtttacgttaccgttagggtacccggttacgggtaacccgaaacgggttacgtaaacggggtaccttaaaacgtaaccgaaacggtacgtggtaaccggtcggtaaccgtactaaccgtacgtttacgtaccgtttccttaacctcgggtttaccccttaccgtcttaaccg

SEQ ID NO: 100862 - DNA, 863 bp, Homo sapiens
  misc_feature: GYAE6OF02GG2FI.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaattgtgttgacactagtctccgagccctacccgttgtccgtttcgtccccgaagggggtaaagcgcccaccctcgttcgttcggcgacgggccgagtacgaacgacctagttacggaacttactacgccgttaggtaacccaacgaggaaacgtccgtacggccacggcctaccccggaggccgtcgcctacagttcctagtcgactggacctaacgttccaaggccgtaacgggcccgtaacgttcgggaccctaacgtccccgtaacgtaccggtacgggtttaccaggggtcggtaccgtaggggtttacgggttccgagggtaacccgtaacgttaccgttaccgtaacccgttcaacccgtacccgtccgtacccggtacgtaccggttaaccctaagggacccgttccggtaaagggttaaaccgttccgggttttaaccggtacgggtttttaaacttaacccgttacggtaaccctaaacgttaacccggttacccgtaaacccgggttccggtaccccgttacggtttaccggttacgggtaccccgttaccggggaacccggtaaaccgggttaccgtaaagggttaaccggaaacttaaccgaaacccggttgtaccggtaccggtacgtaccggaccctaaccgttagttccgtttaacgtcccgtttacgaccctttcccggttaccctggttaaccg

SEQ ID NO: 100863 - DNA, 702 bp, Homo sapiens
  misc_feature: GYAE6OF02F053Y.23.37.D04.1.454.CMB.1.raw
  modified_base (208)..(208): a, c, t, g, unknown or other
  misc_feature (208)..(208): n is a, c, g, or t
  modified_base (657)..(657): a, c, t, g, unknown or other
  misc_feature (657)..(657): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccgacggagtaattgtgttgacacagtctccagccacctgttctttcgtccccgaggggtaaacgngcccaccctctcttgcgacgggccagtcaagcattaggaacttactacgtcctggtaccaacaggaacgcctaggccacggcctccgaggctacgctacatctacgtgtactgtcactccgacggccggtaccgggccctaacgtcggacctaccgttacccgacggtccgttaacggttcggaacgttcggacgttaggtcggggttccgtacggggtaacgtacggtaccttaccgtacccgttacctacccgtaaccgtaacccgttcccgaccgtacggtacccgtaacgtacgaccgtaacggtaacgttacgtttacgggttacgttttacgtacgttcgtaacgaaccgtaacgtaccctacgtcgtccgtacgttacgtcggtaccgtcgacgtacggtacgaaggtaacgtaacacgtaacgtagtcggtacgctcgacncgtacgtcttacggtacttaccgtactcccgtttcccgattaccg

SEQ ID NO: 100864 - DNA, 668 bp, Homo sapiens
  misc_feature: GYAE6OF02FV3AJ.23.37.D04.1.454.CMB.1.raw
  modified_base (199)..(199): a, c, t, g, unknown or other
  misc_feature (199)..(199): n is a, c, g, or t
  modified_base (609)..(609): a, c, t, g, unknown or other
  misc_feature (609)..(609): n is a, c, g, or t
  modified_base (632)..(632): a, c, t, g, unknown or other
  misc_feature (632)..(632): n is a, c, g, or t
  modified_base (662)..(662): a, c, t, g, unknown or other
  misc_feature (662)..(662): n is a, c, g, or t
tcagacgcgagtatcacgaccggtgctcgatttagtagcatactgttgggtttgggggaggaactgctcagttaggacccagagggaaccatggaagccccagctcagcttctctctcctgctactctggcctacccagagaccaccggagatattctttgacacagtctccagcatcgtgtctgtgtctccgaggganagagccaccctctcctgccgagggccaggtcagagtgtacgccgactccgtgccgtgtacctaacaaaaccgttggccacgcctaccctaggccttcgtcacttcacgtggacactatccgaagcggaccacgtcggctacgtccccgaggtaccgtacgggtttacaggtttacggcgaaccggttgggtacccgtacggtttaacggggactacgggttaactttacccggtaacttcccggttaacgtaccgtacttacggacgtaacgtgtttccgggaccctaccgtcggttaacgtttacgttacgtacgttaacgttttacgttacggttacttacgaacgtctaaaccgggtcggtctaccgtacggtctaacgtcctacgttcggaaccgtagcgtacgcngtaacgcgtaaagaccgtaacgnggttccgaatccgactacgcttcgtacgtntaccgg

SEQ ID NO: 100865 - DNA, 740 bp, Homo sapiens
  misc_feature: GYAE6OF02I1HKT.23.37.D04.1.454.CMB.1.raw
tcagacgcgagtatcacgaccggtgctcgatttagtagcatactgttgggtttgggggaggaactgctcagttaggacccagagggaaccatggaagcccccagctcagcttctcttcctcctgctactctggcctcccagagaccaccggagaaattgtgttgacacagtctccagcccaccctgtcctttgtccccgaggggaaagacgccaccctctcttgcgacgggccaggtcaagactagttaggaacttactacgcctaggtaaccaagagaacgcctaggcccgaaggtcctaccgaggctgctcgatctatcgatcgactacgtccagcgacggccagtcggacacgtacccacggtcctaaggttcgacgtaggtcgaggttcgggtcgtacgggactacgtacttcacgtacctacgactacgtccgacgacggaccctaaggccgtacctagggtaaaccgttcgtttacggttacgttttaaacgtaccgtacggttaacctaaaccggttaaaccgtacccaacggttccgtacccgttaccgttcgttacggggtaaccgttaccgggaccgtaaacggggtaacctaaacggggtataaaaccgaaccgttaaaccggactaggggttccgtaacccggtaacgtaacccggtaaccttaacgttcccgttttacgtccccgttaactacccgggtttacccccttacccgggacctttaacgg

SEQ ID NO: 100866 - DNA, 840 bp, Homo sapiens
  misc_feature: GYAE6OF02JO9BX.23.37.D04.1.454.CMB.1.raw
tcagacgcgagtatcacgaccggtgctcgatttagtagcatactgttgggtttgggggaggaactgctcagttacggacccagagggaaccagtaggaacgccccagctcagcttctcttcctcctgctactctggcctccgagagaccacggaagaaattggtgttagacacagtcctaccacgcccgaccctcttcttccgtacccggaagggaacgtaccgacccaacccgttcctcgttacgcggtaccgggaccgacggtacaacggtaactacgttaacgggtaaaccttacgttaacgtaccgttaacgggtaaccaaaccgaaggtaacgtccgtacggaccgacggtccgtacccgaacggtcaacgtccccttagtacttaacgtcgttacgagtttccgacaccgttaccgtaaccggccggaaccggtacccgtaaccggtacggaccccgtacccgtacccggtacggttacccgtaacggtacgtaaccggggtacgtaaccgggttacgggttttcgggaaccggtacggttaacccgggtacgttaaccccggtttagaaccccgtttaccgttacccggtaaccctaaccggtcccgtaccggtacgttaccgaccggttacgaccgtaacgtacggttacgttacggttacggtttacgttacgttacgtaactaacgtaaccgtaccgttacgtccgtaccgtcgtcgtacgtccgtaccgtaccggacgtacgtaacgtaacgaacgtaacgtaccgtagtacgtagacgtacgtactagtccttacgtattaccggtctacttcccgtacctacgtacc

SEQ ID NO: 100867 - DNA, 696 bp, Homo sapiens
  misc_feature: GYAE6OF02IB43B.23.37.D04.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (687)..(687): a, c, t, g, unknown or other
  misc_feature (687)..(687): n is a, c, g, or t
tcagacgcgagtatcacgaccggtgctcgatttagtagcatactgttgggtttgggggagaactgctcagttaggacccagagggaaccatggaagccccagctcagcttctcttcctctgctactctgctccagacgaccaccggagtaaattgtagttgacacagtctccgacgcctaccctgttcttcgtcccgaagggaaagcgccacctctctgcgaggcagtnaacganagtagaactactagccgtagtacaagngaagccgtgccaggtcctccaggctgctcatctagtgatgaccactaccgaggccggacggcctacgggtcgacctaccacccgtaggaccgtaaggttcgaagggttacgcgttaggggtacgggtcgtacggaacggttaacctcttaccgtaccttacaccctcgaacccgtccgactcgtaccgtagtaccgtctagaaacggtttcgttacggttacgtttacttagtactaacgtaaaccgtacgtaaccgtacgtcgtacccgttcgttacgttacggtaccgtacggtaaccggaacggtaccgtaaacggtaaacggaaacttaacccgaaacgttacgtaaggttcggtaacctccgaaccgttacgttcgtactttaccggttcctttaccgtaccgtttcccgtaccccgttntaaacccgg

SEQ ID NO: 100868 - DNA, 706 bp, Homo sapiens
  misc_feature: GYAE6OF02JKSYK.23.37.D04.1.454.CMB.1.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
tcagacgcgagtatcacgaccggtgctcgatttagtagcatactgttgggtttgggggaggaactgctcagttaggaccagagggaaccatggaagccccagctcagcttctcttcctcctgctactctggctcccagagaccaccggagaaattgtgttagacacagtctccagccacctgttcttcgtcccgaggggaanacgccacctctcttgcacgggtccagtcaagactagttaaggaacttacgtacgacgtacgtaccaacgagaaccnccgtcggaccgacggctacccgacggtctcggctacactctagtagaactcgactacgtccgtagccgacggtaccaccggttcggcctacctccgaacgtcccgtaaggtccaggtcggaccgtagggtcgggtacgtacgggactaacggttccttaccggacctttaccgaccgtaaccttaccggtcccgacgtaaccggtacctacggtaccgtacggtacgtaaacgttcgttacggttacgtttacgttaacgtcgttaactacgtaaccgtacgtacgtccggtaccttccggttcgttacggtaccgtacggaccggtaacggaacgtaacggtacgaacgtacgaacgtcgtacgtacgtccgtactacgtaacgtactacgttacttccgtaccttaccttccgtccgtactaaccg

SEQ ID NO: 100869 - DNA, 776 bp, Homo sapiens
  misc_feature: GYAE6OF02H5D7O.23.37.D04.1.454.CMB.1.raw
  modified_base (172)..(172): a, c, t, g, unknown or other
  misc_feature (172)..(172): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactcgtggcctccagacgaccaccggaagtaaattggtgttgacacngtctcacgcccaccttgtcttcgcccgaaggggaacgacgcccaccctctctcgcgacgggcagtacaagactaagttacggaactacgttacgcctaggtaaccaagtacgaacgtccgtgacccgaggcctcccgaagggccttcggcctatactcgtataggtattcgaccgactccgacgacgtacggggcccctaacgcgggaaccacccgtacccggtacgaccgtacggttacagggtttccggacgttacgggggttgggtacggttaacggggcgtacggttaaactccgtaacctccgtactacccgtcgtaccgtacgacgtacctacgtaccgactttaggaaacgttcgttttaccggtacgtttacgttaccgtaacgtaaccgtaaaccttaaccggtaaccttaacgggtccggttaacccttacccgggttacgttaccgggtaccgtacccgggtaacggaccgggttaaaccgtagggtaaaccaagtaaaccgtaaccgggtagacggttacgggtctaccgtaccgacctttacgccgttttacggtccttccgttaacccttccccggtaccgttactacgg

SEQ ID NO: 100870 - DNA, 244 bp, Homo sapiens
  misc_feature: GYAE6OF01AD7GQ.36.57.F02.1.454.CMB.1.raw
  modified_base (243)..(244): a, c, t, g, unknown or other
  misc_feature (243)..(244): n is a, c, g, or t
tcagtacgctgtctcacgaccggtgctcgatttagctcgatatagttggttgggtttggtggtctccactccgccttgacgaggccgattatttctgcggaacatgggacaacgtaagtcctggttttgtcttcggacgtgggaccaaggtcaccgtcctaggtcagcccaaggccaacccactgtcactctgttcccgccctcctcagacagcgtactgagcgggctggcaaggcgcatagnn

SEQ ID NO: 100871 - DNA, 197 bp, Homo sapiens
  misc_feature: GYAE6OF01COLJM.36.57.F02.1.454.CMB.1.raw
  modified_base (194)..(197): a, c, t, g, unknown or other
  misc_feature (194)..(197): n is a, c, g, or t
tcagtacgctgtctcacgaccggtgctcgatttagctcgatatagttgggtttgggcatcaccggactccagactgggacgaggccgattatttctgcggaacatgggacaacgtcagcccaaggccaacccactgtcactctgttcccaccctcctcagacagcgtactgagcgggctggcaaggcgcatagnnnn

SEQ ID NO: 100872 - DNA, 247 bp, Homo sapiens
  misc_feature: GYAE6OF01DQJ4D.36.57.F02.1.454.CMB.1.raw
  modified_base (246)..(247): a, c, t, g, unknown or other
  misc_feature (246)..(247): n is a, c, g, or t
tcagtacgctgtctcacgaccggtgctcgatttagctcgatatagttgggtttgggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggcaaggcgcatagnn

SEQ ID NO: 100873 - DNA, 273 bp, Homo sapiens
  misc_feature: GYAE6OF01BW3OC.36.57.F02.1.454.CMB.1.raw
  modified_base (248)..(273): a, c, t, g, unknown or other
  misc_feature (248)..(273): n is a, c, g, or t
tcagtacgctgtctcacgaccggtgctcgatttagctcgatataggttgggtttggggtttggtgggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccgccctctcagacagcgtactgagcgggctggcaaggcgcatagnnnnnnnnnnnnnnnnnnnnnnnnnn

SEQ ID NO: 100874 - DNA, 250 bp, Homo sapiens
  misc_feature: GYAE6OF01B6OHV.36.57.F02.1.454.CMB.1.raw
  modified_base (248)..(250): a, c, t, g, unknown or other
  misc_feature (248)..(250): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnn

SEQ ID NO: 100875 - DNA, 250 bp, Homo sapiens
  misc_feature: GYAE6OF01B9CP9.36.57.F02.1.454.CMB.1.raw
  modified_base (248)..(250): a, c, t, g, unknown or other
  misc_feature (248)..(250): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnn

SEQ ID NO: 100876 - DNA, 251 bp, Homo sapiens
  misc_feature: GYAE6OF01CQQ5M.36.57.F02.1.454.CMB.1.raw
  modified_base (248)..(251): a, c, t, g, unknown or other
  misc_feature (248)..(251): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccgccctcctcagacagcgtactgagcgggctggcaaggcgcatagnnnn

SEQ ID NO: 100877 - DNA, 255 bp, Homo sapiens
  misc_feature: GYAE6OF01AZB0C.36.57.F02.1.454.CMB.1.raw
  modified_base (249)..(255): a, c, t, g, unknown or other
  misc_feature (249)..(255): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnnn

SEQ ID NO: 100878 - DNA, 250 bp, Homo sapiens
  misc_feature: GYAE6OF01EC7K0.36.57.F02.1.454.CMB.1.raw
  modified_base (249)..(250): a, c, t, g, unknown or other
  misc_feature (249)..(250): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnn

SEQ ID NO: 100879 - DNA, 250 bp, Homo sapiens
  misc_feature: GYAE6OF01CX7T8.36.57.F02.1.454.CMB.1.raw
  modified_base (249)..(250): a, c, t, g, unknown or other
  misc_feature (249)..(250): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccttcctcagacagcgtactgagcgggctggcaaggcgcatagnn

SEQ ID NO: 100880 - DNA, 248 bp, Homo sapiens
  misc_feature: GYAE6OF01APF7J.36.57.F02.1.454.CMB.1.raw
  modified_base (247)..(248): a, c, t, g, unknown or other
  misc_feature (247)..(248): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggcaaggcgcatagnn

SEQ ID NO: 100881 - DNA, 175 bp, Homo sapiens
  misc_feature: GYAE6OF01EZLDB.36.57.F02.1.454.CMB.1.raw
  modified_base (172)..(175): a, c, t, g, unknown or other
  misc_feature (172)..(175): n is a, c, g, or t
tcagtacgctgtctcacgaccggtgctcgatttagctcgatatagttgggttggggaagaggaagactgacggtcctcccaggagttcaggtgctgggcacagcggccctgggctgcctggtcaaggactacttccagacagcgtactgagcgggctggcaaggcgcatagnnnn

SEQ ID NO: 100882 - DNA, 258 bp, Homo sapiens
  misc_feature: GYAE6OF01DTXBJ.36.57.F02.1.454.CMB.1.raw
  modified_base (249)..(258): a, c, t, g, unknown or other
  misc_feature (249)..(258): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnnnn

SEQ ID NO: 100883 - DNA, 251 bp, Homo sapiens
  misc_feature: GYAE6OF01BYLN2.36.57.F02.1.454.CMB.1.raw
  modified_base (248)..(251): a, c, t, g, unknown or other
  misc_feature (248)..(251): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnn

SEQ ID NO: 100884 - DNA, 255 bp, Homo sapiens; identical to SEQ ID NO: 100877
  misc_feature: GYAE6OF01DV6HJ.36.57.F02.1.454.CMB.1.raw
  modified_base (249)..(255): a, c, t, g, unknown or other
  misc_feature (249)..(255): n is a, c, g, or t

SEQ ID NO: 100885 - DNA, 252 bp, Homo sapiens
  misc_feature: GYAE6OF01EA8GW.36.57.F02.1.454.CMB.1.raw
  modified_base (249)..(252): a, c, t, g, unknown or other
  misc_feature (249)..(252): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnn

SEQ ID NO: 100886 - DNA, 251 bp, Homo sapiens
  misc_feature: GYAE6OF01CBJZ2.36.57.F02.1.454.CMB.1.raw
  modified_base (249)..(251): a, c, t, g, unknown or other
  misc_feature (249)..(251): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnn

SEQ ID NO: 100887 - DNA, 249 bp, Homo sapiens
  misc_feature: GYAE6OF01D7AEQ.36.57.F02.1.454.CMB.1.raw
  modified_base (222)..(249): a, c, t, g, unknown or other
  misc_feature (222)..(249): n is a, c, g, or t
tcagtacgctgtctcacgaccggtgctcgatttagctcgatatagttgggtttgggggaaggaggaagactgacggtcctcccaggagttcaggtgcgtgggcaccgtgggcatgggggaggtgtgtcacaagatttgggctctgggcacagccggccctgggctgcctggtcaaggactacttccagacagcgtactgagcgggctggcaaggcgcatagnnnnnnnnnnnnnnnnnnnnnnnnnnnn

SEQ ID NO: 100888 - DNA, 250 bp, Homo sapiens; identical to SEQ ID NO: 100878
  misc_feature: GYAE6OF01C441L.36.57.F02.1.454.CMB.1.raw
  modified_base (249)..(250): a, c, t, g, unknown or other
  misc_feature (249)..(250): n is a, c, g, or t

SEQ ID NO: 100889 - DNA, 252 bp, Homo sapiens
  misc_feature: GYAE6OF01A34H8.36.57.F02.1.454.CMB.1.raw
  modified_base (250)..(252): a, c, t, g, unknown or other
  misc_feature (250)..(252): n is a, c, g, or t
tcagtacgctgtctcacgaccggtgctcgatttagctcgatatagttgggtttggggagtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnn

SEQ ID NO: 100890 - DNA, 206 bp, Homo sapiens
  misc_feature: GYAE6OF01EO8EE.36.57.F02.1.454.CMB.1.raw
  modified_base (196)..(206): a, c, t, g, unknown or other
  misc_feature (196)..(206): n is a, c, g, or t
tcagtacgctgtctcacgaccggtgctcgatttagctcgatatagttgggtttgggcatcaccggactccagactggggacgaggccgattatttctgcggaacatgggacaacgtcagcccaaggccaaccccactgtcactctgttctcgccctcctcagacagcgtactgagcgggctggcaaggcgcatagnnnnnnnnnnn

SEQ ID NO: 100891 - DNA, 249 bp, Homo sapiens
  misc_feature: GYAE6OF01CM75V.36.57.F02.1.454.CMB.1.raw
  modified_base (249)..(249): a, c, t, g, unknown or other
  misc_feature (249)..(249): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagn

SEQ ID NO: 100892 - DNA, 253 bp, Homo sapiens
  misc_feature: GYAE6OF01C4UAK.36.57.F02.1.454.CMB.1.raw
  modified_base (249)..(253): a, c, t, g, unknown or other
  misc_feature (249)..(253): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnn

SEQ ID NO: 100893 - DNA, 252 bp, Homo sapiens
  misc_feature: GYAE6OF01C7FKX.36.57.F02.1.454.CMB.1.raw
  modified_base (250)..(252): a, c, t, g, unknown or other
  misc_feature (250)..(252): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttccccgccctcctcagacagcgtactgagcgggctggcaaggcgcatagnnn

SEQ ID NO: 100894 - DNA, 254 bp, Homo sapiens
  misc_feature: GYAE6OF01CHD4G.36.57.F02.1.454.CMB.1.raw
  modified_base (249)..(254): a, c, t, g, unknown or other
  misc_feature (249)..(254): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnn

SEQ ID NO: 100895 - DNA, 250 bp, Homo sapiens; identical to SEQ ID NO: 100875
  misc_feature: GYAE6OF01C5JI4.36.57.F02.1.454.CMB.1.raw
  modified_base (248)..(250): a, c, t, g, unknown or other
  misc_feature (248)..(250): n is a, c, g, or t

SEQ ID NO: 100896 - DNA, 250 bp, Homo sapiens; identical to SEQ ID NO: 100875
  misc_feature: GYAE6OF01CW6Y9.36.57.F02.1.454.CMB.1.raw
  modified_base (248)..(250): a, c, t, g, unknown or other
  misc_feature (248)..(250): n is a, c, g, or t

SEQ ID NO: 100897 - DNA, 200 bp, Homo sapiens
  misc_feature: GYAE6OF01BS1AY.36.57.F02.1.454.CMB.1.raw
  modified_base (195)..(200): a, c, t, g, unknown or other
  misc_feature (195)..(200): n is a, c, g, or t
tcagtacgctgtctcacgaccggtgctcgatttagctcgatatagttgggtttgggcatcaccggactccagactggggacgaggccgattatttctgcggaacatgggacaacgtcagcccaaggccaacccactgtcactctgttcccgccctcctcagacagcgtactgagcgggctggcaaggcgcatagnnnnnn

SEQ ID NO: 100898 - DNA, 250 bp, Homo sapiens
  misc_feature: GYAE6OF01DYTAB.36.57.F02.1.454.CMB.1.raw
  modified_base (249)..(250): a, c, t, g, unknown or other
  misc_feature (249)..(250): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnn

SEQ ID NO: 100899 - DNA, 251 bp, Homo sapiens; identical to SEQ ID NO: 100886
  misc_feature: GYAE6OF01CZQIY.36.57.F02.1.454.CMB.1.raw
  modified_base (249)..(251): a, c, t, g, unknown or other
  misc_feature (249)..(251): n is a, c, g, or t

SEQ ID NO: 100900 - DNA, 248 bp, Homo sapiens
  misc_feature: GYAE6OF01C3NCS.36.57.F02.1.454.CMB.1.raw
  modified_base (248)..(248): a, c, t, g, unknown or other
  misc_feature (248)..(248): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccacctcctcagacagcgtactgagcgggctggcaaggcgcatagn

SEQ ID NO: 100901 - DNA, 271 bp, Homo sapiens
  misc_feature: GYAE6OF01BXF79.36.57.F02.1.454.CMB.1.raw
  modified_base (252)..(271): a, c, t, g, unknown or other
  misc_feature (252)..(271): n is a, c, g, or t
tcagtacgctgtctcacgaccggtgctcgatttagctcgatatagttgggtttgggggtttgggtggtctccactcccgcctttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggccaaggcgcatagnnnnnnnnnnnnnnnnnnnn

SEQ ID NO: 100902 - DNA, 277 bp, Homo sapiens
  misc_feature: GYAE6OF01EO23Q.36.57.F02.1.454.CMB.1.raw
  modified_base (228)..(228): a, c, t, g, unknown or other
  misc_feature (228)..(228): n is a, c, g, or t
  modified_base (255)..(277): a, c, t, g, unknown or other
  misc_feature (255)..(277): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgancggggggggctggcaaggcgcgatagnnnnnnnnnnnnnnnnnnnnnnn

SEQ ID NO: 100903 - DNA, 252 bp, Homo sapiens
  misc_feature: GYAE6OF01CU3RS.36.57.F02.1.454.CMB.1.raw
  modified_base (249)..(252): a, c, t, g, unknown or other
  misc_feature (249)..(252): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnn

SEQ ID NO: 100904 - DNA, 251 bp, Homo sapiens
  misc_feature: GYAE6OF01C7YXM.36.57.F02.1.454.CMB.1.raw
  modified_base (249)..(251): a, c, t, g, unknown or other
  misc_feature (249)..(251): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnn

SEQ ID NO: 100905 - DNA, 278 bp, Homo sapiens
  misc_feature: GYAE6OF01ATAR1.36.57.F02.1.454.CMB.1.raw
  modified_base (253)..(278): a, c, t, g, unknown or other
  misc_feature (253)..(278): n is a, c, g, or t
tcagtacgctgtctcacgaccggtgctcgatttagctcgatataggtttggggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgcctcctcaggacagcgtactgagcgggctggcaaggcgcatagnnnnnnnnnnnnnnnnnnnnnnnnnn

SEQ ID NO: 100906 - DNA, 249 bp, Homo sapiens; identical to SEQ ID NO: 100891
  misc_feature: GYAE6OF01DZ8Q3.36.57.F02.1.454.CMB.1.raw
  modified_base (249)..(249): a, c, t, g, unknown or other
  misc_feature (249)..(249): n is a, c, g, or t

SEQ ID NO: 100907 - DNA, 254 bp, Homo sapiens
  misc_feature: GYAE6OF01EFELB.36.57.F02.1.454.CMB.1.raw
  modified_base (249)..(254): a, c, t, g, unknown or other
  misc_feature (249)..(254): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnn

SEQ ID NO: 100908 - DNA, 328 bp, Homo sapiens
  misc_feature: GYAE6OF01BGFG6.36.57.F02.1.454.CMB.1.raw
  modified_base (110)..(110): a, c, t, g, unknown or other
  misc_feature (110)..(110): n is a, c, g, or t
  modified_base (201)..(201): a, c, t, g, unknown or other
  misc_feature (201)..(201): n is a, c, g, or t
  modified_base (268)..(328): a, c, t, g, unknown or other
  misc_feature (268)..(328): n is a, c, g, or t
tcagtacgctgtctcacgaccggtgctcgatttagctcgatatagttagggtttagggggtttggtggggtctccactccccgaccttggaccgaggccgattatttcgngcggaacagtcgggacaacgtaagtcctggtttttcgtcgttcggacgtgggaccaaggtcaccgtcctaggtcagcccaaggccaacccntgtcactctgttcccacctcctcagccacgcgtacctcgagccgggctggctaagggcgacaatagnnnnnnnnnnnnnnnnnnnnnnnnnnnnnnnnnnnnnnnnnnnnnnnnnnnnnnnnnnnnn

SEQ ID NO: 100909 - DNA, 251 bp, Homo sapiens
  misc_feature: GYAE6OF01EG6YK.36.57.F02.1.454.CMB.1.raw
  modified_base (243)..(243): a, c, t, g, unknown or other
  misc_feature (243)..(243): n is a, c, g, or t
  modified_base (249)..(251): a, c, t, g, unknown or other
  misc_feature (249)..(251): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggacaaggcncatagnnn

SEQ ID NO: 100910 - DNA, 283 bp, Homo sapiens
  misc_feature: GYAE6OF01B1EYE.36.57.F02.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (252)..(283): a, c, t, g, unknown or other
  misc_feature (252)..(283): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaagggtcaccgtcctaggtcagcccaaggccaaccccatgtcactctgttcccgcctcctcagacagcgtactgagcgggctgggcaaggcncatagngnnnnnnnnnnnnnnnnnnnnnnnnnnnnnnnn

SEQ ID NO: 100911 - DNA, 252 bp, Homo sapiens
  misc_feature: GYAE6OF01ECL7G.36.57.F02.1.454.CMB.1.raw
  modified_base (248)..(252): a, c, t, g, unknown or other
  misc_feature (248)..(252): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggcaaggcgcatagnnnnn

SEQ ID NO: 100912 - DNA, 260 bp, Homo sapiens
  misc_feature: GYAE6OF01EVJLG.36.57.F02.1.454.CMB.1.raw
  modified_base (248)..(260): a, c, t, g, unknown or other
  misc_feature (248)..(260): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctctcagacagcgtactgagcgggctggcaaggcgcatagnnnnnnnnnnnnn

SEQ ID NO: 100913 - DNA, 256 bp, Homo sapiens
  misc_feature: GYAE6OF01CSOLD.36.57.F02.1.454.CMB.1.raw
  modified_base (252)..(256): a, c, t, g, unknown or other
  misc_feature (252)..(256): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaaccccactgtcactctgttcccgccctcctcagacagcgtactgagcgggctggcaaggcgcaatagnnnnn

SEQ ID NO: 100914 - DNA, 268 bp, Homo sapiens
  misc_feature: GYAE6OF01DIAHC.36.57.F02.1.454.CMB.1.raw
  modified_base (253)..(268): a, c, t, g, unknown or other
  misc_feature (253)..(268): n is a, c, g, or t
tcagtacgctgtctcacgaccggtgctcgatttagctcgatataggttggggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccgccctcctcagacagcgtactgagcgggctggcaaggcgcatagnnnnnnnnnnnnnnnn

SEQ ID NO: 100915 - DNA, 251 bp, Homo sapiens; identical to SEQ ID NO: 100904
  misc_feature: GYAE6OF01DXHXS.36.57.F02.1.454.CMB.1.raw
  modified_base (249)..(251): a, c, t, g, unknown or other
  misc_feature (249)..(251): n is a, c, g, or t

SEQ ID NO: 100916 - DNA, 264 bp, Homo sapiens
  misc_feature: GYAE6OF01AJNO1.36.57.F02.1.454.CMB.1.raw
  modified_base (245)..(245): a, c, t, g, unknown or other
  misc_feature (245)..(245): n is a, c, g, or t
  modified_base (251)..(264): a, c, t, g, unknown or other
  misc_feature (251)..(264): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccgccctcctcagacagcgtactgagcgggctggcaaggcncatagnnnnnnnnnnnnnn

SEQ ID NO: 100917 - DNA, 251 bp, Homo sapiens; identical to SEQ ID NO: 100886
  misc_feature: GYAE6OF01EMLX1.36.57.F02.1.454.CMB.1.raw
  modified_base (249)..(251): a, c, t, g, unknown or other
  misc_feature (249)..(251): n is a, c, g, or t

SEQ ID NO: 100918 - DNA, 255 bp, Homo sapiens; identical to SEQ ID NO: 100877
  misc_feature: GYAE6OF01ECQAB.36.57.F02.1.454.CMB.1.raw
  modified_base (249)..(255): a, c, t, g, unknown or other
  misc_feature (249)..(255): n is a, c, g, or t

SEQ ID NO: 100919 - DNA, 263 bp, Homo sapiens
  misc_feature: GYAE6OF01C39XB.36.57.F02.1.454.CMB.1.raw
  modified_base (247)..(263): a, c, t, g, unknown or other
  misc_feature (247)..(263): n is a, c, g, or t
tcagtacgctgtctcacgaccggtgctcgatttagctcgatatagttgggtttgggggttggtggtctccactcccgccttgacgaggccgattatttctgcggaacatgggacaacgtaagtcctggttttgtcttcggacgtgggaccaaggtcaccgtcctaggtcagcccaaggccaacccatgtcactctgttcccgccctcctcagacagcgtactgagcgggctggccaaggcgcatagnnnnnnnnnnnnnnnnn

SEQ ID NO: 100920 - DNA, 264 bp, Homo sapiens
  misc_feature: GYAE6OF01CB53X.36.57.F02.1.454.CMB.1.raw
  modified_base (251)..(264): a, c, t, g, unknown or other
  misc_feature (251)..(264): n is a, c, g, or t
tcagtacgctgtctcacgaccggtgctcgatttagctcgatatagttggggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgaggcgggctggcaaggcgcatagnnnnnnnnnnnnnn

SEQ ID NO: 100921 - DNA, 254 bp, Homo sapiens
  misc_feature: GYAE6OF01B9PQD.36.57.F02.1.454.CMB.1.raw
  modified_base (251)..(254): a, c, t, g, unknown or other
  misc_feature (251)..(254): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttccccgccctcctcagacagcgtactgagcgggctggcaaggcgcatagnnnn

SEQ ID NO: 100922 - DNA, 253 bp, Homo sapiens
  misc_feature: GYAE6OF01DZQ89.36.57.F02.1.454.CMB.1.raw
  modified_base (248)..(253): a, c, t, g, unknown or other
  misc_feature (248)..(253): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctctcagacagcgtactgagcgggctggcaaggcgcatagnnnnnn

SEQ ID NO: 100923 - DNA, 253 bp, Homo sapiens
  misc_feature: GYAE6OF01ALU1S.36.57.F02.1.454.CMB.1.raw
  modified_base (251)..(253): a, c, t, g, unknown or other
  misc_feature (251)..(253): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcgcatagnnn

SEQ ID NO: 100924 - DNA, 250 bp, Homo sapiens
  misc_feature: GYAE6OF01EEM0P.36.57.F02.1.454.CMB.1.raw
  modified_base (250)..(250): a, c, t, g, unknown or other
  misc_feature (250)..(250): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagtn

SEQ ID NO: 100925 - DNA, 256 bp, Homo sapiens
  misc_feature: GYAE6OF01BYGUA.36.57.F02.1.454.CMB.1.raw
  modified_base (249)..(256): a, c, t, g, unknown or other
  misc_feature (249)..(256): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnn

SEQ ID NO: 100926 - DNA, 258 bp, Homo sapiens
  misc_feature: GYAE6OF01CR8V4.36.57.F02.1.454.CMB.1.raw
  modified_base (244)..(244): a, c, t, g, unknown or other
  misc_feature (244)..(244): n is a, c, g, or t
  modified_base (250)..(258): a, c, t, g, unknown or other
  misc_feature (250)..(258): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttccccaccctcctcagacagcgtactgagcgggctggcaaggcncatagnnnnnnnnn

SEQ ID NO: 100927 - DNA, 252 bp, Homo sapiens
  misc_feature: GYAE6OF01ELV71.36.57.F02.1.454.CMB.1.raw
  modified_base (250)..(252): a, c, t, g, unknown or other
  misc_feature (250)..(252): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnn

SEQ ID NO: 100928 - DNA, 261 bp, Homo sapiens
  misc_feature: GYAE6OF01AHU7N.36.57.F02.1.454.CMB.1.raw
  modified_base (251)..(261): a, c, t, g, unknown or other
  misc_feature (251)..(261): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaacccccactgtcactctgttcccaccctcctcagacagcgtactgagcgggctggcaaggcgcatagnnnnnnnnnnn

SEQ ID NO: 100929 - DNA, 265 bp, Homo sapiens
  misc_feature: GYAE6OF01BB2BS.36.57.F02.1.454.CMB.1.raw
  modified_base (253)..(265): a, c, t, g, unknown or other
  misc_feature (253)..(265): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaagggtcaccgtcctaggtcagcccaaaggccaaccccactgtcactctgttcccgccctcctcagacagcgtactgagcgggctgcgaaggcgcatagnnnnnnnnnnnnn

SEQ ID NO: 100930 - DNA, 259 bp, Homo sapiens
  misc_feature: GYAE6OF01B1TR9.36.57.F02.1.454.CMB.1.raw
  modified_base (250)..(259): a, c, t, g, unknown or other
  misc_feature (250)..(259): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccgccctcctcagacagcgtactgagcgggctggcaaggcgcatagnnnnnnnnnn

SEQ ID NO: 100931 - DNA, 291 bp, Homo sapiens
  misc_feature: GYAE6OF01ASPM7.36.57.F02.1.454.CMB.1.raw
  modified_base (246)..(246): a, c, t, g, unknown or other
  misc_feature (246)..(246): n is a, c, g, or t
  modified_base (252)..(291): a, c, t, g, unknown or other
  misc_feature (252)..(291): n is a, c, g, or t
tcagtacgctgtctcacgaccggtgctcgatttagctcgatatagttgggtttggggggtttggtggtcgtccactcccgccttgacgaggccgattatttctgcggaacatgggacaacgtaagtcctggtttttgtcttcggacgtgggaccaaggtcaccgtcctaggtcagcccaaaggccaaccccatgtcactctgttcccaccctcctcagacagcgtactgagcgggctggcaaggcncatagnnnnnnnnnnnnnnnnnnnnnnnnnnnnnnnnnnnnnnnn

SEQ ID NO: 100932 - DNA, 256 bp, Homo sapiens
  misc_feature: GYAE6OF01DSKYZ.36.57.F02.1.454.CMB.1.raw
  modified_base (251)..(256): a, c, t, g, unknown or other
  misc_feature (251)..(256): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggcccaaccccactgtcactctgttcccaccctcctcagacagcgtactgagcgggctggcaaggcgcatagnnnnnn

SEQ ID NO: 100933 - DNA, 288 bp, Homo sapiens
  misc_feature: GYAE6OF01BXI5R.36.57.F02.1.454.CMB.1.raw
  modified_base (252)..(288): a, c, t, g, unknown or other
  misc_feature (252)..(288): n is a, c, g, or t
tcagtacgctgtctcacgaccggtgctcgatttagctcgatatagttgggtttgggggggtttggtggtctccactcccgccttgacgaggccgattatttctgcggaacactgggacaacgtaagtcctggtttttgtcttcggacgtgggaccaaggtcaccgtcctaggtcagcccaaggccaacccactgtcactctgttcccgccctcctcagacagcgtactgagcgggctggcaaggcgcatagnnnnnnnnnnnnnnnnnnnnnnnnnnnnnnnnnnnnn

SEQ ID NO: 100934 - DNA, 258 bp, Homo sapiens
  misc_feature: GYAE6OF01EMOZX.36.57.F02.1.454.CMB.1.raw
  modified_base (244)..(244): a, c, t, g, unknown or other
  misc_feature (244)..(244): n is a, c, g, or t
  modified_base (250)..(258): a, c, t, g, unknown or other
  misc_feature (250)..(258): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaacccactgtcactctgttcccaccctcctcagacagcgtactgagcgggctggcaaggcncatagnnnnnnnnn

SEQ ID NO: 100935 - DNA, 259 bp, Homo sapiens
  misc_feature: GYAE6OF01C5N9Z.36.57.F02.1.454.CMB.1.raw
  modified_base (251)..(259): a, c, t, g, unknown or other
  misc_feature (251)..(259): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggcccaaccccactgtcactctgttccccaccctcctcagacagcgtactgagcgggctggcaaggcgcatagnnnnnnnnn

SEQ ID NO: 100936 - DNA, 256 bp, Homo sapiens
  misc_feature: GYAE6OF01ECKWX.36.57.F02.1.454.CMB.1.raw
  modified_base (249)..(256): a, c, t, g, unknown or other
  misc_feature (249)..(256): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaacccactgtcactctgttcccaccctcctcagacagcgtactgagcgggctggcaaggcgcatagnnnnnnnn

SEQ ID NO: 100937 - DNA, 256 bp, Homo sapiens
  misc_feature: GYAE6OF01AUMU2.36.57.F02.1.454.CMB.1.raw
  modified_base (249)..(256): a, c, t, g, unknown or other
  misc_feature (249)..(256): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctctcagacagcgtactgagcgggctggcaaggcgcatagnnnnnnnn

SEQ ID NO: 100938 - DNA, 259 bp, Homo sapiens
  misc_feature: GYAE6OF01C48RW.36.57.F02.1.454.CMB.1.raw
  modified_base (249)..(259): a, c, t, g, unknown or other
  misc_feature (249)..(259): n is a, c, g, or t
tcagtacgctgtctcacgaccggtgctcgatttagctcgatatagttgggtttgggggtttggtggtctccactcccgccttgacgaggccgattatttctgcggaacacgggacaacgtaagtcctggtttttgtcttcggacgtgggaccaaggtcaccgtcctaggtcagcccaaggccaaccccatgtcactctgttcccgccctcctcagacagcgtactgagcgggctggcaaggcgcatagnnnnnnnnnnn

SEQ ID NO: 100939 - DNA, 255 bp, Homo sapiens
  misc_feature: GYAE6OF01CM2W8.36.57.F02.1.454.CMB.1.raw
  modified_base (248)..(255): a, c, t, g, unknown or other
  misc_feature (248)..(255): n is a, c, g, or t
tcagtacgctgtctcacgaccggtgctcgatttagctcgatatagttgggtttgggggttggtggtctccactcccgccttgacgaggccgattatttctgcggaacatgggacaacgtaagtcctggttttgtcttcggacgtgggaccaaggtcaccgtcctaggtcagcccaaggcccaaccccatgtcactctgttcccgccctcctcagacagcgtactgagcgggctggcaaggcgcatagnnnnnnnn

SEQ ID NO: 100940 - DNA, 264 bp, Homo sapiens
  misc_feature: GYAE6OF01APDGT.36.57.F02.1.454.CMB.1.raw
  modified_base (252)..(264): a, c, t, g, unknown or other
  misc_feature (252)..(264): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaacccccactgtcactctgttcccgccctcctcagacagcgtactgagcgggctggcaaggcgcatagnnnnnnnnnnnnn

SEQ ID NO: 100941 - DNA, 261 bp, Homo sapiens
  misc_feature: GYAE6OF01B29U1.36.57.F02.1.454.CMB.1.raw
  modified_base (245)..(261): a, c, t, g, unknown or other
  misc_feature (245)..(261): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtccttgttttgtcttcggacgtgggaccaaggtcaccgtctaggtcagcccaagccaaccccactgtcactctcgttcccgcctcctcagacagcgtactgagcggctggcaagcgcatagnnnnnnnnnnnnnnnnn

SEQ ID NO: 100942 - DNA, 276 bp, Homo sapiens
  misc_feature: GYAE6OF01D2WUI.36.57.F02.1.454.CMB.1.raw
  modified_base (136)..(136): a, c, t, g, unknown or other
  misc_feature (136)..(136): n is a, c, g, or t
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
  modified_base (255)..(276): a, c, t, g, unknown or other
  misc_feature (255)..(276): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtccttggtttttntcttcggacgtgggaccaaggtcaccgtcctaggtcacgcccaaggcccaaccccactgtcactctcgttccccaccctcctnacgacagtcgtactgaggcggctggcaggcncatgnnnnnnnnnnnnnnnnnnnnnn

SEQ ID NO: 100943 - DNA, 270 bp, Homo sapiens
  misc_feature: GYAE6OF01EKWNO.36.57.F02.1.454.CMB.1.raw
  modified_base (250)..(270): a, c, t, g, unknown or other
  misc_feature (250)..(270): n is a, c, g, or t
tcagtacgctgtctcacgaccggtgctcgatttagctcgatatagttggggtttggggggtttggtggtctccactcccgccttgacgaggccgattatttctgcggaacatgggacaaacgtaagtcctggttttgtcttcggacgtggaccaaggtcaccgtcctaggtcagcccaaggccaacccatgtcactctcgttcccaccttcctcagacagctacgtgagcggctggccaaggcgcaatgnnnnnnnnnnnnnnnnnnnnn

SEQ ID NO: 100944 - DNA, 261 bp, Homo sapiens
  misc_feature: GYAE6OF01CG2T2.36.57.F02.1.454.CMB.1.raw
  modified_base (243)..(243): a, c, t, g, unknown or other
  misc_feature (243)..(243): n is a, c, g, or t
  modified_base (249)..(261): a, c, t, g, unknown or other
  misc_feature (249)..(261): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggcaaggcncatagnnnnnnnnnnnnn

SEQ ID NO: 100945 - DNA, 259 bp, Homo sapiens
  misc_feature: GYAE6OF01EFT3E.36.57.F02.1.454.CMB.1.raw
  modified_base (249)..(259): a, c, t, g, unknown or other
  misc_feature (249)..(259): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaacccactgtcactctgttcccaccctcctcagacagcgtactgagcgggctggcaaggcgcatagnnnnnnnnnnn

SEQ ID NO: 100946 - DNA, 273 bp, Homo sapiens
  misc_feature: GYAE6OF01A7LL2.36.57.F02.1.454.CMB.1.raw
  modified_base (257)..(273): a, c, t, g, unknown or other
  misc_feature (257)..(273): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctacgttcccaccctcctcagacagccgtactggagcgggctgggacaagggcgcatagnnnnnnnnnnnnnnnnn

SEQ ID NO: 100947 - DNA, 264 bp, Homo sapiens
  misc_feature: GYAE6OF01A2YMF.36.57.F02.1.454.CMB.1.raw
  modified_base (227)..(227): a, c, t, g, unknown or other
  misc_feature (227)..(227): n is a, c, g, or t
  modified_base (254)..(264): a, c, t, g, unknown or other
  misc_feature (254)..(264): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggcccaaccccatgtcactctcgttcccgccctccgtcagacagccgtangagcgggctggaccaggtcgacatggnnnnnnnnnnn

SEQ ID NO: 100948 - DNA, 267 bp, Homo sapiens
  misc_feature: GYAE6OF01DTP1I.36.57.F02.1.454.CMB.1.raw
  modified_base (249)..(267): a, c, t, g, unknown or other
  misc_feature (249)..(267): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactggagcgggctggcaaggcgcatagnnnnnnnnnnnnnnnnnnn

SEQ ID NO: 100949 - DNA, 249 bp, Homo sapiens
  misc_feature: GYAE6OF02GRU39.36.57.F02.1.454.CMB.1.raw
  modified_base (247)..(249): a, c, t, g, unknown or other
  misc_feature (247)..(249): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccgccctcctcagacagcgtactgagcgggctggcaaggcgcatagnnn

SEQ ID NO: 100950 - DNA, 248 bp, Homo sapiens
  misc_feature: GYAE6OF02I6700.36.57.F02.1.454.CMB.1.raw
  modified_base (246)..(248): a, c, t, g, unknown or other
  misc_feature (246)..(248): n is a, c, g, or t
tcagtacgctgtctcacgaccggtgctcgatttagctcgatatagttgggtttgggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccgccctcctcagacagcgtactgagcgggctggcaaggcgcatagnnn

SEQ ID NO: 100951 - DNA, 251 bp, Homo sapiens; identical to SEQ ID NO: 100886
  misc_feature: GYAE6OF02JBFNT.36.57.F02.1.454.CMB.1.raw
  modified_base (249)..(251): a, c, t, g, unknown or other
  misc_feature (249)..(251): n is a, c, g, or t

SEQ ID NO: 100952 - DNA, 247 bp, Homo sapiens
  misc_feature: GYAE6OF02IDAEV.36.57.F02.1.454.CMB.1.raw
  modified_base (247)..(247): a, c, t, g, unknown or other
  misc_feature (247)..(247): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccgccctcctcagacagcgtactgagcgggctggcaaggcgcatagn

SEQ ID NO: 100953 - DNA, 247 bp, Homo sapiens
  misc_feature: GYAE6OF02GN007.36.57.F02.1.454.CMB.1.raw
  modified_base (246)..(247): a, c, t, g, unknown or other
  misc_feature (246)..(247): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccacctcctcagacagcgtactgagcgggctggcaaggcgcatagnn

SEQ ID NO: 100954 - DNA, 247 bp, Homo sapiens
  misc_feature: GYAE6OF02IWI19.36.57.F02.1.454.CMB.1.raw
  modified_base (245)..(247): a, c, t, g, unknown or other
  misc_feature (245)..(247): n is a, c, g, or t
tcagtacgctgtctcacgaccggtgctcgatttagctcgatatagttgggtttgggttggtggtctccactcccgccttgacgaggccgattatttctgcggaacatgggacaacgtaagtcctggttttgtcttcggacgtgggaccaaggtcaccgtcctaggtcagcccaaggccaacccactgtcactctgttcccaccctcctcagacagcgtactgagcgggctggcaaggcgcatagnnn

SEQ ID NO: 100955 - DNA, 252 bp, Homo sapiens
  misc_feature: GYAE6OF02G9Z1R.36.57.F02.1.454.CMB.1.raw
  modified_base (248)..(252): a, c, t, g, unknown or other
  misc_feature (248)..(252): n is a, c, g, or t
tcagtacgctgtctcacgaccggtgctcgatttagctcgatatagttgggtttggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnn

SEQ ID NO: 100956 - DNA, 249 bp, Homo sapiens
  misc_feature: GYAE6OF02HE1WF.36.57.F02.1.454.CMB.1.raw
  modified_base (249)..(249): a, c, t, g, unknown or other
  misc_feature (249)..(249): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagn

SEQ ID NO: 100957 - DNA, 252 bp, Homo sapiens; identical to SEQ ID NO: 100885
  misc_feature: GYAE6OF02INCHH.36.57.F02.1.454.CMB.1.raw
  modified_base (249)..(252): a, c, t, g, unknown or other
  misc_feature (249)..(252): n is a, c, g, or t

SEQ ID NO: 100958 - DNA, 270 bp, Homo sapiens
  misc_feature: GYAE6OF02IY0RU.36.57.F02.1.454.CMB.1.raw
  modified_base (249)..(270): a, c, t, g, unknown or other
  misc_feature (249)..(270): n is a, c, g, or t
tcagtacgctgtctcacgaccggtgctcgatttagctcgatatagttgggtttgggggtttgggtggtctccactcccgccttgacgaggccgattatttctgcggaacatgggacaacgtaagtcctggttttgtcttcggacgtgggaccaaggtcgccgtcctaggtcagcccaaggccaacccactgtcactctgttcccaccctcctcagacagcgtactgagcgggctggcaaggcgcatagnnnnnnnnnnnnnnnnnnnnnn

SEQ ID NO: 100959 - DNA, 254 bp, Homo sapiens
  misc_feature: GYAE6OF02I61HJ.36.57.F02.1.454.CMB.1.raw
  modified_base (250)..(254): a, c, t, g, unknown or other
  misc_feature (250)..(254): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctcggttttgtcttcggacgtgggaccaaggtcaccgtcctaggtcagcccaaggccaaccccactgtcactctgttcccgccctcctcagacagcgtactgagcgggctggcaaggcgcatagnnnnn

SEQ ID NO: 100960 - DNA, 272 bp, Homo sapiens
  misc_feature: GYAE6OF02HSTP8.36.57.F02.1.454.CMB.1.raw
  modified_base (248)..(272): a, c, t, g, unknown or other
  misc_feature (248)..(272): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctctcagacagcgtactgagcgggctggcaaggcgcatagnnnnnnnnnnnnnnnnnnnnnnnnn

SEQ ID NO: 100961 - DNA, 174 bp, Homo sapiens
  misc_feature: GYAE6OF02FRIVL.36.57.F02.1.454.CMB.1.raw
  modified_base (174)..(174): a, c, t, g, unknown or other
  misc_feature (174)..(174): n is a, c, g, or t
tcagtacgctgtctcacgaccggtgctcgatttagctcgatatagttgggtttgggggaagaggaagactgacggtcctcccaggagttcaggtgctgggcacagcggccctgggctgcctggtcaaggactacttccagacagcgtactgagcgggctggcaaggcgcatagn

SEQ ID NO: 100962 - DNA, 254 bp, Homo sapiens; identical to SEQ ID NO: 100907
  misc_feature: GYAE6OF02HPDF2.36.57.F02.1.454.CMB.1.raw
  modified_base (249)..(254): a, c, t, g, unknown or other
  misc_feature (249)..(254): n is a, c, g, or t

SEQ ID NO: 100963 - DNA, 249 bp, Homo sapiens
  misc_feature: GYAE6OF02IPXGQ.36.57.F02.1.454.CMB.1.raw
  modified_base (248)..(249): a, c, t, g, unknown or other
  misc_feature (248)..(249): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgcctcctcagacagcgtactgagcgggctggcaaggcgcatagnn

SEQ ID NO: 100964 - DNA, 268 bp, Homo sapiens
  misc_feature: GYAE6OF02G72KE.36.57.F02.1.454.CMB.1.raw
  modified_base (251)..(268): a, c, t, g, unknown or other
  misc_feature (251)..(268): n is a, c, g, or t
tcagtacgctgtctcacgaccggtgctcgatttagctcgatatagttgggtttgggggtttggtggtctccacgtcccgccttgacgaggccgattatttctgcggaacatgggacaacgtaagtcctggttttgtcttcggacgtgggacccaaggtcaccgtcctaggtcagcccaaggccaaccccactgtcactctgttcccgccctcctcagacagcgtactgagcgggctggcaaggcgcatagnnnnnnnnnnnnnnnnnn

SEQ ID NO: 100965 - DNA, 269 bp, Homo sapiens
  misc_feature: GYAE6OF02GFW2Z.36.57.F02.1.454.CMB.1.raw
  modified_base (250)..(269): a, c, t, g, unknown or other
  misc_feature (250)..(269): n is a, c, g, or t
tcagtacgctgtctcacgaccggtgctcgatttagctcgatatagttgggtttgggggtttgggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnnnnnnnnnnn

SEQ ID NO: 100966 - DNA, 272 bp, Homo sapiens
  misc_feature: GYAE6OF02GL1D9.36.57.F02.1.454.CMB.1.raw
  modified_base (250)..(272): a, c, t, g, unknown or other
  misc_feature (250)..(272): n is a, c, g, or t
tcagtacgctgtctcacgaccggtgctcgatttagctcgatatagttgggtttgggggtttgggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnnnnnnnnnnnnnn

SEQ ID NO: 100967 - DNA, 253 bp, Homo sapiens
  misc_feature: GYAE6OF02H4GVX.36.57.F02.1.454.CMB.1.raw
  modified_base (249)..(253): a, c, t, g, unknown or other
  misc_feature (249)..(253): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnn

SEQ ID NO: 100968 - DNA, 251 bp, Homo sapiens; identical to SEQ ID NO: 100886
  misc_feature: GYAE6OF02HLL39.36.57.F02.1.454.CMB.1.raw
  modified_base (249)..(251): a, c, t, g, unknown or other
  misc_feature (249)..(251): n is a, c, g, or t

SEQ ID NO: 100969 - DNA, 250 bp, Homo sapiens; identical to SEQ ID NO: 100898
  misc_feature: GYAE6OF02FTZM2.36.57.F02.1.454.CMB.1.raw
  modified_base (249)..(250): a, c, t, g, unknown or other
  misc_feature (249)..(250): n is a, c, g, or t

SEQ ID NO: 100970 - DNA, 251 bp, Homo sapiens; identical to SEQ ID NO: 100904
  misc_feature: GYAE6OF02HVFEU.36.57.F02.1.454.CMB.1.raw
  modified_base (249)..(251): a, c, t, g, unknown or other
  misc_feature (249)..(251): n is a, c, g, or t

SEQ ID NO: 100971 - DNA, 261 bp, Homo sapiens
  misc_feature: GYAE6OF02F1BXA.36.57.F02.1.454.CMB.1.raw
  modified_base (249)..(261): a, c, t, g, unknown or other
  misc_feature (249)..(261): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnnnnnnnnn

SEQ ID NO: 100972 - DNA, 264 bp, Homo sapiens
  misc_feature: GYAE6OF02JFBVY.36.57.F02.1.454.CMB.1.raw
  modified_base (249)..(264): a, c, t, g, unknown or other
  misc_feature (249)..(264): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatggnnnnnnnnnnnnnnnn

SEQ ID NO: 100973 - DNA, 253 bp, Homo sapiens; identical to SEQ ID NO: 100967
  misc_feature: GYAE6OF02G45X8.36.57.F02.1.454.CMB.1.raw
  modified_base (249)..(253): a, c, t, g, unknown or other
  misc_feature (249)..(253): n is a, c, g, or t

SEQ ID NO: 100974 - DNA, 249 bp, Homo sapiens; identical to SEQ ID NO: 100891
  misc_feature: GYAE6OF02GX7UN.36.57.F02.1.454.CMB.1.raw
  modified_base (249)..(249): a, c, t, g, unknown or other
  misc_feature (249)..(249): n is a, c, g, or t

SEQ ID NO: 100975 - DNA, 252 bp, Homo sapiens; identical to SEQ ID NO: 100903
  misc_feature: GYAE6OF02IGPNV.36.57.F02.1.454.CMB.1.raw
  modified_base (249)..(252): a, c, t, g, unknown or other
  misc_feature (249)..(252): n is a, c, g, or t

SEQ ID NO: 100976 - DNA, 263 bp, Homo sapiens
  misc_feature: GYAE6OF02I43H0.36.57.F02.1.454.CMB.1.raw
  modified_base (249)..(263): a, c, t, g, unknown or other
  misc_feature (249)..(263): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnnnnnn

SEQ ID NO: 100977 - DNA, 250 bp, Homo sapiens; identical to SEQ ID NO: 100898
  misc_feature: GYAE6OF02H8SBF.36.57.F02.1.454.CMB.1.raw
  modified_base (249)..(250): a, c, t, g, unknown or other
  misc_feature (249)..(250): n is a, c, g, or t

SEQ ID NO: 100978 - DNA, 203 bp, Homo sapiens
  misc_feature: GYAE6OF02JDB8E.36.57.F02.1.454.CMB.1.raw
  modified_base (196)..(203): a, c, t, g, unknown or other
  misc_feature (196)..(203): n is a, c, g, or t
tcagtacgctgtctcacgaccggtgctcgatttagctcgatatagttgggtttgggcatcaccggactccagactggggacgaggccgattatttctgcggaacatgggacaacgtcagcccaaggccaaccccactgtcactctgttcccgccctcctcagacagcgtactgagcgggctggcaaggcgcatagnnnnnnnn

SEQ ID NO: 100979 - DNA, 264 bp, Homo sapiens
  misc_feature: GYAE6OF02HX5V2.36.57.F02.1.454.CMB.1.raw
  modified_base (249)..(264): a, c, t, g, unknown or other
  misc_feature (249)..(264): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctctcagacagcgtactgagcgggctggcaaggcgcatagnnnnnnnnnnnnnnnn

SEQ ID NO: 100980 - DNA, 258 bp, Homo sapiens
  misc_feature: GYAE6OF02H07OH.36.57.F02.1.454.CMB.1.raw
  modified_base (248)..(258): a, c, t, g, unknown or other
  misc_feature (248)..(258): n is a, c, g, or t
tcagtacgctgtctcacgaccggtgctcgatttagctcgatatagttgggtttgggggtttggtggtctccactccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnnnnnnn

SEQ ID NO: 100981 - DNA, 253 bp, Homo sapiens; identical to SEQ ID NO: 100892
  misc_feature: GYAE6OF02JFRPM.36.57.F02.1.454.CMB.1.raw
  modified_base (249)..(253): a, c, t, g, unknown or other
  misc_feature (249)..(253): n is a, c, g, or t

SEQ ID NO: 100982 - DNA, 251 bp, Homo sapiens; identical to SEQ ID NO: 100886
  misc_feature: GYAE6OF02IJ01Y.36.57.F02.1.454.CMB.1.raw
  modified_base (249)..(251): a, c, t, g, unknown or other
  misc_feature (249)..(251): n is a, c, g, or t

SEQ ID NO: 100983 - DNA, 251 bp, Homo sapiens; identical to SEQ ID NO: 100876
  misc_feature: GYAE6OF02HEWZO.36.57.F02.1.454.CMB.1.raw
  modified_base (248)..(251): a, c, t, g, unknown or other
  misc_feature (248)..(251): n is a, c, g, or t

SEQ ID NO: 100984 - DNA, 275 bp, Homo sapiens
  misc_feature: GYAE6OF02HHOOA.36.57.F02.1.454.CMB.1.raw
  modified_base (249)..(275): a, c, t, g, unknown or other
  misc_feature (249)..(275): n is a, c, g, or t
tcagtacgctgtctcacgaccggtgctcgatttagctcgatatagttggggtttgggggtttggtggtctccactccgccttgacgaggccgattatttctgcggaacatgggacaacgtaagtcctggttttgtcttcggacgtgggaccaaggtcaccgtcctaggtcagcccaaggccaaccccatgtcactctgttcccgccctctcagacagcgtactgagcgggctgggccaaggcgcatagnnnnnnnnnnnnnnnnnnnnnnnnnnn

SEQ ID NO: 100985 - DNA, 252 bp, Homo sapiens; identical to SEQ ID NO: 100885
  misc_feature: GYAE6OF02GU55V.36.57.F02.1.454.CMB.1.raw
  modified_base (249)..(252): a, c, t, g, unknown or other
  misc_feature (249)..(252): n is a, c, g, or t

SEQ ID NO: 100986 - DNA, 276 bp, Homo sapiens
  misc_feature: GYAE6OF02FJE0J.36.57.F02.1.454.CMB.1.raw
  modified_base (250)..(276): a, c, t, g, unknown or other
  misc_feature (250)..(276): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnnnnnnnnnnnnnnnnnn

SEQ ID NO: 100987 - DNA, 252 bp, Homo sapiens; identical to SEQ ID NO: 100903
  misc_feature: GYAE6OF02FQ6Q7.36.57.F02.1.454.CMB.1.raw
  modified_base (249)..(252): a, c, t, g, unknown or other
  misc_feature (249)..(252): n is a, c, g, or t

SEQ ID NO: 100988 - DNA, 255 bp, Homo sapiens; identical to SEQ ID NO: 100877
  misc_feature: GYAE6OF02IA1QI.36.57.F02.1.454.CMB.1.raw
  modified_base (249)..(255): a, c, t, g, unknown or other
  misc_feature (249)..(255): n is a, c, g, or t

SEQ ID NO: 100989 - DNA, 267 bp, Homo sapiens
  misc_feature: GYAE6OF02GXDM4.36.57.F02.1.454.CMB.1.raw
  modified_base (251)..(267): a, c, t, g, unknown or other
  misc_feature (251)..(267): n is a, c, g, or t
tcagtacgctgtctcacgaccggtgctcgatttagctcgatatagttgggtttgggggtttggtggtcgtccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtacgtgagcgggctggcaaggcgcatagnnnnnnnnnnnnnnnnn

SEQ ID NO: 100990 - DNA, 250 bp, Homo sapiens; identical to SEQ ID NO: 100878
  misc_feature: GYAE6OF02HKGM3.36.57.F02.1.454.CMB.1.raw
  modified_base (249)..(250): a, c, t, g, unknown or other
  misc_feature (249)..(250): n is a, c, g, or t

SEQ ID NO: 100991 - DNA, 315 bp, Homo sapiens
  misc_feature: GYAE6OF02HEV0X.36.57.F02.1.454.CMB.1.raw
  modified_base (258)..(315): a, c, t, g, unknown or other
  misc_feature (258)..(315): n is a, c, g, or t
tcagtacgctgtctcacgaccggtgctcgatttagctcgatatagttggggtttggggtgtttggtggtctccacgtcccgccttgaccgaggccgattactttcgtgcggaacatgggacaaccgtaagtccctggttttgtcttcggacggtgggaccaagggtcaccggtcctaggtcagcccaaggccaacccactgtcactctgttcccgcctcctcagacagcgtactgagcgggctggcaaggcgcatagnnnnnnnnnnnnnnnnnnnnnnnnnnnnnnnnnnnnnnnnnnnnnnnnnnnnnnnnnn

SEQ ID NO: 100992 - DNA, 270 bp, Homo sapiens
  misc_feature: GYAE6OF02FUS15.36.57.F02.1.454.CMB.1.raw
  modified_base (251)..(270): a, c, t, g, unknown or other
  misc_feature (251)..(270): n is a, c, g, or t
tcagtacgctgtctcacgaccggtgctcgatttagctcgatatagttgggtttgggggtttggtggtctccactcccgccttgacgaggccgattatttctgcggaacatgggacaacgtaacgtcctggttttgtcttcggacgtgggaccaagggtcaccgtcctaggtcagcccaaggccaaccccactgtcactctgttcccgccctcctcagacagcgtactgagcgggctggcaaggcgcatagnnnnnnnnnnnnnnnnnnnn

SEQ ID NO: 100993 - DNA, 251 bp, Homo sapiens; identical to SEQ ID NO: 100904
  misc_feature: GYAE6OF02GHT6W.36.57.F02.1.454.CMB.1.raw
  modified_base (249)..(251): a, c, t, g, unknown or other
  misc_feature (249)..(251): n is a, c, g, or t

SEQ ID NO: 100994 - DNA, 252 bp, Homo sapiens; identical to SEQ ID NO: 100903
  misc_feature: GYAE6OF02HAPW4.36.57.F02.1.454.CMB.1.raw
  modified_base (249)..(252): a, c, t, g, unknown or other
  misc_feature (249)..(252): n is a, c, g, or t

SEQ ID NO: 100995 - DNA, 352 bp, Homo sapiens
  misc_feature: GYAE6OF02GX8CL.36.57.F02.1.454.CMB.1.raw
  modified_base (254)..(259): a, c, t, g, unknown or other
  misc_feature (254)..(259): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (281)..(352): a, c, t, g, unknown or other
  misc_feature (281)..(352): n is a, c, g, or t
tcagtacgctgtctcacgaccggtgctcgatttagctcgatataggttggggtttgggggtttggtggtctccacgtcccgccttgacgaggccgattatttctgcggaacatgggacaacgtaagtcctggttttgtcttcggactgggaccaagggtcaccgtcctaggtcagcccaaagggccaaaccccatggtcactctgttcccacctctcagacagcgtactgagcgggctggcaaggtcgcatagnnnnnnancagancntgctgngatncgnnnnnnnnnnnnnnnnnnnnnnnnnnnnnnnnnnnnnnnnnnnnnnnnnnnnnnnnnnnnnnnnnnnnnnnn

SEQ ID NO: 100996 - DNA, 254 bp, Homo sapiens; identical to SEQ ID NO: 100894
  misc_feature: GYAE6OF02JA38A.36.57.F02.1.454.CMB.1.raw
  modified_base (249)..(254): a, c, t, g, unknown or other
  misc_feature (249)..(254): n is a, c, g, or t

SEQ ID NO: 100997 - DNA, 252 bp, Homo sapiens; identical to SEQ ID NO: 100885
  misc_feature: GYAE6OF02HH11M.36.57.F02.1.454.CMB.1.raw
  modified_base (249)..(252): a, c, t, g, unknown or other
  misc_feature (249)..(252): n is a, c, g, or t

SEQ ID NO: 100998 - DNA, 252 bp, Homo sapiens; identical to SEQ ID NO: 100903
  misc_feature: GYAE6OF02HYX1T.36.57.F02.1.454.CMB.1.raw
  modified_base (249)..(252): a, c, t, g, unknown or other
  misc_feature (249)..(252): n is a, c, g, or t

SEQ ID NO: 100999 - DNA, 257 bp, Homo sapiens
  misc_feature: GYAE6OF02H8TD0.36.57.F02.1.454.CMB.1.raw
  modified_base (250)..(257): a, c, t, g, unknown or other
  misc_feature (250)..(257): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcgcatagnnnnnnnn

SEQ ID NO: 101000 - DNA, 272 bp, Homo sapiens
  misc_feature: GYAE6OF02I8RQ7.36.57.F02.1.454.CMB.1.raw
  modified_base (249)..(272): a, c, t, g, unknown or other
  misc_feature (249)..(272): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaagggtcaccgtcctaggtcagcccaaggccaaccccactgtcactctgttcccgcctcctcagacagcgtactgagcgggctggcaaggcgcatagnnnnnnnnnnnnnnnnnnnnnnnn

SEQ ID NO: 101001 - DNA, 253 bp, Homo sapiens
  misc_feature: GYAE6OF02FWUUD.36.57.F02.1.454.CMB.1.raw
  modified_base (250)..(253): a, c, t, g, unknown or other
  misc_feature (250)..(253): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccgccctcctcagacagcgtactgagcgggctggcaaggcgcatagnnnn

SEQ ID NO: 101002 - DNA, 261 bp, Homo sapiens
  misc_feature: GYAE6OF02HJ922.36.57.F02.1.454.CMB.1.raw
  modified_base (251)..(261): a, c, t, g, unknown or other
  misc_feature (251)..(261): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnn

SEQ ID NO: 101003 - DNA, 252 bp, Homo sapiens
  misc_feature: GYAE6OF02H3AB4.36.57.F02.1.454.CMB.1.raw
  modified_base (249)..(252): a, c, t, g, unknown or other
  misc_feature (249)..(252): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccgccctctcagacagcgtactgagcgggctggcaaggcgcatagnnnn

SEQ ID NO: 101004 - DNA, 270 bp, Homo sapiens
  misc_feature: GYAE6OF02F8L9J.36.57.F02.1.454.CMB.1.raw
  modified_base (250)..(270): a, c, t, g, unknown or other
  misc_feature (250)..(270): n is a, c, g, or t
tcagtacgctgtctcacgaccggtgctcgatttagctcgatatagttgggtttcgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnnnnnnnnnnnnnnnn

SEQ ID NO: 101005 - DNA, 251 bp, Homo sapiens; identical to SEQ ID NO: 100904
  misc_feature: GYAE6OF02G2K82.36.57.F02.1.454.CMB.1.raw
  modified_base (249)..(251): a, c, t, g, unknown or other
  misc_feature (249)..(251): n is a, c, g, or t

SEQ ID NO: 101006 - DNA, 253 bp, Homo sapiens
  misc_feature: GYAE6OF02GMREJ.36.57.F02.1.454.CMB.1.raw
  modified_base (249)..(253): a, c, t, g, unknown or other
  misc_feature (249)..(253): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcccagacagcgtactgagcgggctggcaaggcgcatagnnnnn

SEQ ID NO: 101007 - DNA, 256 bp, Homo sapiens
  misc_feature: GYAE6OF02I9LNG.36.57.F02.1.454.CMB.1.raw
  modified_base (249)..(256): a, c, t, g, unknown or other
  misc_feature (249)..(256): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnnnn

SEQ ID NO: 101008 - DNA, 257 bp, Homo sapiens
  misc_feature: GYAE6OF02JE4CB.36.57.F02.1.454.CMB.1.raw
  modified_base (249)..(257): a, c, t, g, unknown or other
  misc_feature (249)..(257): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccgccctcctcagacagcgtactgagcgggctggcaaggcgcatagnnnnnnnnn

SEQ ID NO: 101009 - DNA, 253 bp, Homo sapiens; identical to SEQ ID NO: 100892
  misc_feature: GYAE6OF02JYWUN.36.57.F02.1.454.CMB.1.raw
  modified_base (249)..(253): a, c, t, g, unknown or other
  misc_feature (249)..(253): n is a, c, g, or t

SEQ ID NO: 101010 - DNA, 275 bp, Homo sapiens
  misc_feature: GYAE6OF02G22I8.36.57.F02.1.454.CMB.1.raw
  modified_base (228)..(228): a, c, t, g, unknown or other
  misc_feature (228)..(228): n is a, c, g, or t
  modified_base (253)..(275): a, c, t, g, unknown or other
  misc_feature (253)..(275): n is a, c, g, or t
tcagtacgctgtctcacgaccggtgctcgatttagctcgatatagttggggtttgggggtttggtggtctccactccgccttgacgaggccgattatttcctgcggaacatgggacaacgttaagtcctggttttgtcttcggacgtgggaccaaggtcaccgtcctaggtcaagcccaaggccaaccccactgtcactctgttccccaccctctcagacagcgtacngagccgggctggcaaggcgcatagnnnnnnnnnnnnnnnnnnnnnnn

SEQ ID NO: 101011 - DNA, 254 bp, Homo sapiens
  misc_feature: GYAE6OF02HC08T.36.57.F02.1.454.CMB.1.raw
  modified_base (251)..(254): a, c, t, g, unknown or other
  misc_feature (251)..(254): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcgcatagnnnn

SEQ ID NO: 101012 - DNA, 323 bp, Homo sapiens
  misc_feature: GYAE6OF02JQHL2.36.57.F02.1.454.CMB.1.raw
  modified_base (270)..(276): a, c, t, g, unknown or other
  misc_feature (270)..(276): n is a, c, g, or t
  modified_base (278)..(323): a, c, t, g, unknown or other
  misc_feature (278)..(323): n is a, c, g, or t
tcagtacgctgtctcacgaccggtgctcgatttagctcgatatagttgggggtttgggggggtttggtaggtcgtccactccccgccttgacggaggccgattatttctgcggaacgatggggacaacgtaagtccctggttttgtcttcggacgtgggaccaaggtcacgtcctaggtcagcccgaaggccaaccccactgtcactctgttccccgccctcctcagacacggccgtacgtgaggcggggctcggcaagggcgcactagnnnnnnngnnnnnnnnnnnnnnnnnnnnnnnnnnnnnnnnnnnnnnnnnnnnnn

SEQ ID NO: 101013 - DNA, 266 bp, Homo sapiens
  misc_feature: GYAE6OF02GG8MX.36.57.F02.1.454.CMB.1.raw
  modified_base (251)..(266): a, c, t, g, unknown or other
  misc_feature (251)..(266): n is a, c, g, or t
tcagtacgctgtctcacgaccggtgctcgatttagctcgatatagttgggtttgggggtttggtggtctccactcccgccttgaccgaggccgattatttctgcggaacatgggacaacgtaagtcctggttttgtcttcggacgtgggaccaaggtcaccgtcctaggtcagcccaaggcccaaaccccatgtcactctgttcccaccctcctcagacagcgtactgagcgggctggcaaggcgcatagnnnnnnnnnnnnnnnn

SEQ ID NO: 101014 - DNA, 199 bp, Homo sapiens
  misc_feature: GYAE6OF02GGCNB.36.57.F02.1.454.CMB.1.raw
  modified_base (195)..(199): a, c, t, g, unknown or other
  misc_feature (195)..(199): n is a, c, g, or t
tcagtacgctgtctcacgaccggtgctcgatttagctcgatatagttgggtttgggcatcaccggactccagactggggacgaggccgattatttctgcggaacatgggacaacgtcagcccaaggccaaccccactgtcactctgttcccgccctcctcagacagcgtactgagcggctggcaaggcgcatagnnnnn

SEQ ID NO: 101015 - DNA, 256 bp, Homo sapiens
  misc_feature: GYAE6OF02GIMWZ.36.57.F02.1.454.CMB.1.raw
  modified_base (245)..(245): a, c, t, g, unknown or other
  misc_feature (245)..(245): n is a, c, g, or t
  modified_base (251)..(256): a, c, t, g, unknown or other
  misc_feature (251)..(256): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaaggccaaaccccatgtcactctgttcccgccctcctcagacagcgtactgagcgggctggcaaaggcncatagnnnnnn

SEQ ID NO: 101016 - DNA, 267 bp, Homo sapiens
  misc_feature: GYAE6OF02FH2XW.36.57.F02.1.454.CMB.1.raw
  modified_base (253)..(267): a, c, t, g, unknown or other
  misc_feature (253)..(267): n is a, c, g, or t
tcagtacgctgtctcacgaccggtgctcgatttagctcgatatagttgggtttggggggtttggtggtctccactcccgccttgacgaggccgatttatttctgcggaacatgggacaacgtaagtcctggtttttgtcttcggacgtgggaccaaggtcaccgtcctaggtcagcccaaggccaaccccactgtcactctcgttcccaccctcctcagacagcgtactgagcgggctggcaaggcgcatagnnnnnnnnnnnnnnn

SEQ ID NO: 101017 - DNA, 264 bp, Homo sapiens
  misc_feature: GYAE6OF02HI6QO.36.57.F02.1.454.CMB.1.raw
  modified_base (245)..(245): a, c, t, g, unknown or other
  misc_feature (245)..(245): n is a, c, g, or t
  modified_base (251)..(264): a, c, t, g, unknown or other
  misc_feature (251)..(264): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttcgtcttcggacgtgggaccaaggtcaccgtcctaggtcagcccaaggccaaccccatgtcactctgttcccaccctcctcagacagcgtactgagcgggctggcaaggcncatagnnnnnnnnnnnnnn

SEQ ID NO: 101018 - DNA, 255 bp, Homo sapiens
  misc_feature: GYAE6OF02F57IE.36.57.F02.1.454.CMB.1.raw
  modified_base (244)..(244): a, c, t, g, unknown or other
  misc_feature (244)..(244): n is a, c, g, or t
  modified_base (249)..(255): a, c, t, g, unknown or other
  misc_feature (249)..(255): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctcctcagacagcgtactgagcgggctggcaaggcncatgnnnnnnn

SEQ ID NO: 101019 - DNA, 300 bp, Homo sapiens
  misc_feature: GYAE6OF02JCPGW.36.57.F02.1.454.CMB.1.raw
  modified_base (258)..(259): a, c, t, g, unknown or other
  misc_feature (258)..(259): n is a, c, g, or t
  modified_base (261)..(300): a, c, t, g, unknown or other
  misc_feature (261)..(300): n is a, c, g, or t
tcagtacgctgtctcacgaccggtgctcgatttagctcgatatagttggggtttgggggtttggtggtctccactcccgccttgacgaggccgattatttctgcggaacatgggacaacgtaagtcctggttttgtcttcggacgtggacccaaggtccaccgtcctaggtcagcccaaggccaaccccactgtcacctctgttccccgccctcctcacgacagccgtactgagccgggctggaccaaggcgcatagnntnnnnnnnnnnnnnnnnnnnnnnnnnnnnnnnnnnnnnnnn

SEQ ID NO: 101020 - DNA, 261 bp, Homo sapiens; identical to SEQ ID NO: 100971
  misc_feature: GYAE6OF02H5LNO.36.57.F02.1.454.CMB.1.raw
  modified_base (249)..(261): a, c, t, g, unknown or other
  misc_feature (249)..(261): n is a, c, g, or t

SEQ ID NO: 101021 - DNA, 255 bp, Homo sapiens
  misc_feature: GYAE6OF02HJF0R.36.57.F02.1.454.CMB.1.raw
  modified_base (249)..(255): a, c, t, g, unknown or other
  misc_feature (249)..(255): n is a, c, g, or t
tcagtacgctgtctcacgaccggtgctcgatttagctcgatatagttgggtttgggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnn

SEQ ID NO: 101022 - DNA, 259 bp, Homo sapiens; identical to SEQ ID NO: 100930
  misc_feature: GYAE6OF02HJIWF.36.57.F02.1.454.CMB.1.raw
  modified_base (250)..(259): a, c, t, g, unknown or other
  misc_feature (250)..(259): n is a, c, g, or t

SEQ ID NO: 101023 - DNA, 285 bp, Homo sapiens
  misc_feature: GYAE6OF02HS1OX.36.57.F02.1.454.CMB.1.raw
  modified_base (253)..(285): a, c, t, g, unknown or other
  misc_feature (253)..(285): n is a, c, g, or t
tcagtacgctgtctcacgaccggtgctcgatttagctcgatatagttgggtttgggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttcccaccctctcagacagcgtactgacgcgggctggacaaggcgcatagnnnnnnnnnnnnnnnnnnnnnnnnnnnnnnnnn

SEQ ID NO: 101024 - DNA, 260 bp, Homo sapiens
  misc_feature: GYAE6OF02HORT2.36.57.F02.1.454.CMB.1.raw
  modified_base (246)..(246): a, c, t, g, unknown or other
  misc_feature (246)..(246): n is a, c, g, or t
  modified_base (252)..(260): a, c, t, g, unknown or other
  misc_feature (252)..(260): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggtttttgtcttcggacgtgggaccaaggtcaccgtcctaggtcagcccaaggccaaccccactgtcactctgttccccaccctcctcagacagcgtactgagcgggctggcaaggcncatagnnnnnnnnn

SEQ ID NO: 101025 - DNA, 289 bp, Homo sapiens
  misc_feature: GYAE6OF02FLFLP.36.57.F02.1.454.CMB.1.raw
  modified_base (250)..(256): a, c, t, g, unknown or other
  misc_feature (250)..(256): n is a, c, g, or t
  modified_base (258)..(289): a, c, t, g, unknown or other
  misc_feature (258)..(289): n is a, c, g, or t
tcagtacgctgtctcacgaccggtgctcgatttagctcgatatagttgggtttggggggtttggtggtctccactcccgccttgacgaggccgattatttctgcggaacatgggacaacgtaagtcctggttttgtcttcggacgtgggaccaaggtcaccgtcctaggtcagcccaaggccaaccccactgtcactctgttcccaccctcctcagacagcgtactgagcgggctggcaaggcgcatagnnnnnnncnnnnnnnnnnnnnnnnnnnnnnnnnnnnnnnn

SEQ ID NO: 101026 - DNA, 638 bp, Homo sapiens
  misc_feature: GYAE6OF02H9UW9.36.57.F02.1.454.CMB.1.raw
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagtacgctgtctcacgaccggtgctcgatttagctcgatatagttgggtttggggctccctctactgatgaaaaccagcccagccctgaccctgcagctctgggagacgagcccagcactggaagtcgccggtgtttccattcggtgatcatcactgaacacagagactcacatggagtttggactgagctgggttctcctcgttgcttcgttttaaggggtctccgagttgtcgaggtgcgagtcgtgggtaggaatcggtgggggagctagtcggtccaaggtcgagggaccgttcccagacgtactctcccgtgtcgacgacgtccctgtggtatttcgagtcttcgaggtactacgactactccgacgttgggccnccacgtccacgaggacgaaggcgtgggnggtggggacncgtacgtcttaatgttctagtagtacgtggaaataacgtaaatttaaacgtaccgtaacgacgaacgttaccggtacgggtacggaacggggtcccttaagttcccttaacacgttccctaacgagtaacgtaaccttaacgtaccaaacgttacccacgttcgtccttaacgcgtaacctacgtacgaacgtacgcccgtagtacccgacgtacggg

SEQ ID NO: 101027 - DNA, 328 bp, Homo sapiens
  misc_feature: GYAE6OF02GFIRR.36.57.F02.1.454.CMB.1.raw
  modified_base (195)..(195): a, c, t, g, unknown or other
  misc_feature (195)..(195): n is a, c, g, or t
  modified_base (278)..(328): a, c, t, g, unknown or other
  misc_feature (278)..(328): n is a, c, g, or t
tcagtacgctgtctcacgaccggtgctcgatttagctcgatataggttggggtttggggggtttggtggtctccactcccgccttgacgaggccgattatttctgcggaacagtggggacaacgtaagtccttggttttgtcttcggacgtgggaccaaggtcaccgtcctaggtcagcccaaggcccaaccccntgtcactcgttcgttccccacccctcctcgaaggacagccgtacgtgacggccggggctgggactaagggccgactaagtggnnnnnnnnnnnnnnnnnnnnnnnnnnnnnnnnnnnnnnnnnnnnnnnnnnn

SEQ ID NO: 101028 - DNA, 278 bp, Homo sapiens
  misc_feature: GYAE6OF02FYMVM.36.57.F02.1.454.CMB.1.raw
  modified_base (254)..(278): a, c, t, g, unknown or other
  misc_feature (254)..(278): n is a, c, g, or t
tcagtacgctgtctcacgaccggtgctcgatttagctcgatatagttgggtttggggggtttggtggtctccactcccgccttgacgaggccgattatttctgcggaaccatgggacaacgtaagtcctggtttttgtcttcggacgtgggaccaaggtcaccgtcctaggtcagcccaaggccaaccccactgtcactctcgttcccgccctacctcagacagcgtactgagcgggctggcaaggcgcatagnnnnnnnnnnnnnnnnnnnnnnnnn

SEQ ID NO: 101029 - DNA, 278 bp, Homo sapiens
  misc_feature: GYAE6OF02F4M42.36.57.F02.1.454.CMB.1.raw
  modified_base (252)..(278): a, c, t, g, unknown or other
  misc_feature (252)..(278): n is a, c, g, or t
tcagtacgctgtctcacgaccggtgctcgatttagctcgatatagttggggtttggggggtttggtggtctccactcccgccttgacgaggccgattatttctgcggaacatggggacaacgtaagtcctggtttttgtcttcggacgtgggaccaaggtcaccgtcctaggtcagcccaaggccaaaccccatgtcactctgttcccgccctctcagacagcgtactgagcgggctggcaaggcgcatagnnnnnnnnnnnnnnnnnnnnnnnnnnn

SEQ ID NO: 101030 - DNA, 142 bp, Homo sapiens
  misc_feature: GYAE6OF01A4AGY.5.72.G06.1.454.CMB.1.raw
  modified_base (142)..(142): a, c, t, g, unknown or other
  misc_feature (142)..(142): n is a, c, g, or t
tcagatcagacacgcacgaccggtgctcgatttagctacgactgcaagggaaagggcacgaccggtgctcgatttagctacgactgcctggtcaaggactacttcccgtgtctgatctgagcgggctggcaaggcgcatagn

SEQ ID NO: 101031 - DNA, 142 bp, Homo sapiens; identical to SEQ ID NO: 101030
  misc_feature: GYAE6OF01D1Z7Z.5.72.G06.1.454.CMB.1.raw
  modified_base (142)..(142): a, c, t, g, unknown or other
  misc_feature (142)..(142): n is a, c, g, or t

SEQ ID NO: 101032 - DNA, 143 bp, Homo sapiens
  misc_feature: GYAE6OF02I0IQ6.5.72.G06.1.454.CMB.1.raw
  modified_base (142)..(143): a, c, t, g, unknown or other
  misc_feature (142)..(143): n is a, c, g, or t
tcagatcagacacgcacgaccggtgctcgatttagctacgactgcaagggaaagggcacgaccggtgctcgatttagctacgactgtctggtcaaggactacttcccgtgtctgatctgagcgggctggcaaggcgcatagnn

SEQ ID NO: 101033 - DNA, 534 bp, Homo sapiens
  misc_feature: GYAE6OF01DZ6KN.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgtttcgggtgttcggcggagggaccaagctcgaccgtcctaggtccagcccaaggcctcgcccccgtggtccactcctcgttccccaccctcctcgctacgtacgactgacgcgggctcgg

SEQ ID NO: 101034 - DNA, 526 bp, Homo sapiens
  misc_feature: GYAE6OF01EZEGT.15.5.A05.1.454.CMB.1.raw
  modified_base (364)..(364): a, c, t, g, unknown or other
  misc_feature (364)..(364): n is a, c, g, or t
  modified_base (521)..(521): a, c, t, g, unknown or other
  misc_feature (521)..(521): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaaacagaagcctggccaagcccccaggacactgatttatgataacaaacaacaaacactcctcggacccctgcccggttctcagctccctcgttggggcaagctgccctgaccctttcgggngcgcagcctgagatgaggctgagtattactgcttgctctctatagtgtgttcgggtgttcggcggagggaccagcgtgaccgtcgtaggtcagcccaaggctcgcccctcggtcacctctcgttcccaccctcctcgctacgtcgactgacggcggngtcgg

SEQ ID NO: 101035 - DNA, 518 bp, Homo sapiens
  misc_feature: GYAE6OF01DQZE0.15.5.A05.1.454.CMB.1.raw
  modified_base (360)..(360): a, c, t, g, unknown or other
  misc_feature (360)..(360): n is a, c, g, or t
  modified_base (513)..(513): a, c, t, g, unknown or other
  misc_feature (513)..(513): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgttggggcaaagctgccctgaccctttcggngcgcagcctgaggatgagctgagtatactgcttgctctcctatagtgtgttcgggtgttcggcggaggaccaagctgaccgtctaggtcagcccaagctcgcccctcggtccactcctcgttcccaccctcctcgctacgtcactgacgcggngtcgg

SEQ ID NO: 101036 - DNA, 514 bp, Homo sapiens
  misc_feature: GYAE6OF01A7KQH.15.5.A05.1.454.CMB.1.raw
  modified_base (357)..(357): a, c, t, g, unknown or other
  misc_feature (357)..(357): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcagctccctcgttggggcaagctgcctgaccttcggngcgcagcctgaggatgaggctgagtattactgcttgctctcctatagtggtgttcgggtgttcggcggaggaccaagctgaccgtcctaggtcagcccaaggctcgcccctgtccactctcgtcccgccctccncgctacgtnactgcgcgggctgg

SEQ ID NO: 101037 - DNA, 524 bp, Homo sapiens
  misc_feature: GYAE6OF01EGDTT.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggttgttcgggtgttcggcggagggaccaaggctgaccgtcctaggtcagcccaaggctcgcccctggtccactctcgttcccaccctcctcgctacgtgactgacgcggctgg

SEQ ID NO: 101038 - DNA, 738 bp, Homo sapiens
  misc_feature: GYAE6OF01AYMJL.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgatacaaacaacaaacactcctcggacccctgcccggttctcaggctccgtcgttggggcaaagctacgcctgaccagttcggtgcgcacgcccgtagacggtatggacggtcgtaggtacgttagttacgttgtctttggtccttcctaccttagtaggttgggtttcgggtttccggggttcggttttccggggcggggtaacggggtaacccgtaaacggtccgttacgggtaaccccggttacccggttaacgggttcccgaacgggtacccccgtaaacgggtcccgttacccgggtaccccccccgttaccggggttcccctaacccggttttcccgttaccccgggtttcccccccggtccccccgtttccccgttacccgggttaccccgttaaacccgggttaaccgtaacccggtttacgggaaccgggtcccgggggttacccggg

SEQ ID NO: 101039 - DNA, 530 bp, Homo sapiens
  misc_feature: GYAE6OF01BKQTA.15.5.A05.1.454.CMB.1.raw
  modified_base (525)..(525): a, c, t, g, unknown or other
  misc_feature (525)..(525): n is a, c, g, or t
tcagtctacgtagccacgaccggtgctcgatttagatagatagacagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgttcgggtgttcggcggagggacaagctgaccgtcctaggtcagcccaaggctcgcccctcggtccactcgtcgttccccgcccttcctccgctacgtagacctgacgcgggntcggg

SEQ ID NO: 101040 - DNA, 562 bp, Homo sapiens
  misc_feature: GYAE6OF01DEY59.15.5.A05.1.454.CMB.1.raw
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacngaagcctggccaagcccccaggacactgattatgatacaaacaacaaacactcctggacccctgcccggttctcaggctccctcgtggggcaaagctgccctgacccttcggtncgcagcctgaggatgaggctgagtaatacgtgcttgctctcctatagtggtgttcgggtgttcggcggtaggaccaaggctgaccgtcctaggtcacgcccaaggcctcggtccccctcgggtcctacttccgtcgttcccccggccccttcccgtccggaccttaccgttacgaacccttggaacggtcgggctaccgggg

SEQ ID NO: 101041 - DNA, 520 bp, Homo sapiens
  misc_feature: GYAE6OF01AU18O.15.5.A05.1.454.CMB.1.raw
  modified_base (504)..(504): a, c, t, g, unknown or other
  misc_feature (504)..(504): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgttcgggtgttcggcggaggacagctgaccgtctaggtcagcccaaggctcgcccctcgtcactctcgttcccaccctcctcgctacgtanactgacgcggcgtcgg

SEQ ID NO: 101042 - DNA, 521 bp, Homo sapiens
  misc_feature: GYAE6OF01EIAOC.15.5.A05.1.454.CMB.1.raw
tcagtctacgtagccacgaccggtgctcgatttagatagatagacaggggtcccgttccaatatcagcaccatggcctggactcctctctttctgttcctcctcacttgctgcccaggtccaattcccaggctgtggtgactcaggagccctcactgactgtgtccccaggagggacagtcactctcacctgtggctccagcactggagctgtcaccaatggtcattatcccatggttccaaacagaagcctggccaagcccccaggacactgatttatcgatacaaacaacaaacactcctggacccctgacccggttctcaggctccctcgttggggcaaagctgccctgacccttcggtgcgcagcctgaggactgaggctgagtattactgcttgctctcctatagtggtgttcgggtgttcggtgaggaccagctgaccgtccaggtcagccaaggctgcccctggtcactcgtcgttcccgccttcctcgctacgtacactgacgcgggctcggg

SEQ ID NO: 101043 - DNA, 529 bp, Homo sapiens
  misc_feature: GYAE6OF01B4D23.15.5.A05.1.454.CMB.1.raw
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgacgatgaggctgagtattactgcttgctctcctatagtggtgttcgggtgtttcggcggagggaccaagctgaccgtccgtaggtcagcccaaggctcgcccctggtccactctcgttcccaccctccncgcctacgtnactgacgcgggctcggg

SEQ ID NO: 101044 - DNA, 522 bp, Homo sapiens
  misc_feature: GYAE6OF01CFISV.15.5.A05.1.454.CMB.1.raw
  modified_base (362)..(362): a, c, t, g, unknown or other
  misc_feature (362)..(362): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggngcgcagcctgaggatgaggctgagtattactgcttgctctcctatagtggtgttcggtgttcggcggaggacaagctgaccgtcctaggtcagcccaaggctcgcccctggtccactctcgtcccaccctcctcgctacgtagactgacgcgggctcggg

SEQ ID NO: 101045 - DNA, 534 bp, Homo sapiens
  misc_feature: GYAE6OF01BVHFK.15.5.A05.1.454.CMB.1.raw
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggaccactgatttatgatacaaacaacaaacactcctggacccctgcccggttctcaggctccctcgttggggcaaagctgcccctgaccctttcgggtcgcgcagcctgacggatgaggctgagtattactgcttgctctctatagtgtgttcgggtgttcggcggngggaccaagctgaccgtccgtaggtcacgcccaaggcctcgccccctggtccactccgtcgttcccccnctccgcctacgtagactgagcggcgtggacg

SEQ ID NO: 101046 - DNA, 530 bp, Homo sapiens
  misc_feature: GYAE6OF01A5KBW.15.5.A05.1.454.CMB.1.raw
  modified_base (364)..(364): a, c, t, g, unknown or other
  misc_feature (364)..(364): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtncgcagcctgaggatgaggctgagtattactgcttgctctcctatagtgtgttcgggtgttcgggcggagggaccaagctgaccgtcctaggtcagcccaaggctcgccccctgtcacctctcgttccccaccctcctccgctacgtacgactgacgcgggctcggg

SEQ ID NO: 101047 - DNA, 532 bp, Homo sapiens
  misc_feature: GYAE6OF01DOTFR.15.5.A05.1.454.CMB.1.raw
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagcctggccaagcccccaggacactgatttatgatacaaacaacaaacactcctggacccctgcccggttctcaggctcccgtcgttcggggcaagctcgccctgtacccttcgggtcgcgcagcctgaggatgaggctgagtattactgcttgctctcctatagtggtgttcgggtgttcggcggagggaccaagctgaccgtcgtaggtcagcccaggcncgccccctggccnctcgtcgttcccaccctcctccgctacgtgactggacgcggcgtcggg

SEQ ID NO: 101048 - DNA, 523 bp, Homo sapiens
  misc_feature: GYAE6OF01C34TO.15.5.A05.1.454.CMB.1.raw
  modified_base (430)..(430): a, c, t, g, unknown or other
  misc_feature (430)..(430): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaaacagaagcctggccaagcccccaggacactgatttatgatacaaaacaacaaacactcctcggacccctgcccggttctcagctccctcggttggggcaaagctgccctgtaccctttcggttgcgcagcctgaggatgagctgagtattactgcttgctctctatagtggtgttcgggtgtcggnggacggacagctgaccgtctagtcagccaaggctcgcccctgccactccgtcttcccaccctccnccgtctacgtcactggacgcggngtcgg

SEQ ID NO: 101049 - DNA, 566 bp, Homo sapiens
  misc_feature: GYAE6OF01BTVQL.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctgacccctgcccgttctcagctcctcgtgggcaagctcgcctcgacccttcggtgcgcagcctgacgatggagctagagtattacgtgtcttgctctcctataggtggttgtcgggttgtcggcggtagggaccaagcgtcgaccgtcgtaggtccacgcccgaaggcctccgccccgttcggtccaccgtccgttcccgttaccccacccccgttcgtcccgtaccgttaccggtacgaccgttaggacggtccgggtcgtacggg

SEQ ID NO: 101050 - DNA, 518 bp, Homo sapiens
  misc_feature: GYAE6OF01A7F3E.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcgggtgcgcagcctgaggatgaggctgagtattactgcttgctctctatagtgtgttcgggtgttcggcgagggacagctgaccgtctaggtcagcccaaggctcgcccctgtccactcgtcgttcccaccctcctcgctacgtagactgacgcggctcgg

SEQ ID NO: 101051 - DNA, 520 bp, Homo sapiens
  misc_feature: GYAE6OF01AQUNC.15.5.A05.1.454.CMB.1.raw
  modified_base (516)..(516): a, c, t, g, unknown or other
  misc_feature (516)..(516): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcagctccctcgttggggcaaagctgccctgacccttcgggtgcgcagcctgaggatgaggctgagtattactgcttgctctcctatagtggtgttcgggtgttcggcggagggacaagctgaccgtctaggtcagcccaaggctcgcccctggtccactctcgtcccgccctcctcgctacgtagactgacgcggntcgg

SEQ ID NO: 101052 - DNA, 533 bp, Homo sapiens
  misc_feature: GYAE6OF01ET6HG.15.5.A05.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactccnggacccctgcccggttctcaggctccctcgttggggcaaagctgccctgaccctttcgggngcgcagcctgaggatgaggctgagtattactgcttgctctcctatagtggtgttcgggtgttcggcggtaggaccaagctgaccgtctagttcagcccaaggctcgcccctcggtccacgtcgtcgttcccnccctcccncgtcctacgtagacctgacgcgggctcggg

SEQ ID NO: 101053 - DNA, 718 bp, Homo sapiens
  misc_feature: GYAE6OF01EF1CE.15.5.A05.1.454.CMB.1.raw
tcagtctacgtagccacgaccggtgctcgatttagatagatagacgagggtcccttccaattatcagcaccatggcctggactcctctctttctgttcctcctcacttgctgcccagggtccaattcccaggctcgtggtgactcaggagccctcactgactgtgtccccaggagggacagtcactctcactgtggctccagcactggagctgtcaccaatggtcagttactccctacgtggttacccaaactagaacgcctcggacccaacgcccccaggaccacgtagtatttatgtattaacaaacaacaaacactcctacggacccctcgcccggttctcgacggtcctcccgtcggttcggggacaaagctcgccctcgtacccctttcgggtcgccggacacgtcccgtagaggtagtaggaggtcgtagtagttactttacgtagtcgttacgtcttcttaccttaagttacggttcgggtttcggtttaccggggttggtttccgggacgggtaacgggtaccgtaaggtccgtacggtacccggttacgttacgggtaccacggtacccgtaacgggtcctacccggtccccgtccggttaccctaacgttcccgttacccggtttcccccgtacccccgttccccgtaccggtccccgttaacccggttacggaacgttccgggacgggtccggggcggttaaccggg

SEQ ID NO: 101054 - DNA, 540 bp, Homo sapiens
  misc_feature: GYAE6OF01B8Y6L.15.5.A05.1.454.CMB.1.raw
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
  modified_base (523)..(523): a, c, t, g, unknown or other
  misc_feature (523)..(523): n is a, c, g, or t
tcagtctacgtagccacgaccggtgctcgatttagatagatagacaggggtcccttccaatatcagcaccatggccctggactcctctctttctgttcctcctcacttgctgcccagggtccaattcccaggctgtggtgactcaggagccctcactgactgtgtccccaggtagggacagtcactctcacctgtggctccagcactggagctgtcaccaagtggtcattatccctactggttccaacagaagcctggccaagccccaggacactgattatgatacaaacaacaaacactccaggacccctgcccggttctcgaggcctcctcgttcggggacaaagctagccctgacccttcggntcgcagcctgaggatggagctgagtattacngcttgctctctatagtgtgttggtgttcggcggaggacaagctgaccgtctaggtcacgccgaaggctacgcccctcggtctaccgtctcgttacccaccctcctccgtaccgtacgtacggacgnggacgccgggctccggg

SEQ ID NO: 101055 - DNA, 584 bp, Homo sapiens
  misc_feature: GYAE6OF01DT8HB.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgattatgatacaaacaacaaacactcctcggacccctgcccgttctcagctcctcgtggggcaaagctcgccctgtacccttcgggtgccgcacgcctggaggatggaggctgagttattacgtgtcttcgctctcctatagttggtgttcgggtgttcgggcggacggacaagctgaccgttccgtaggtccacgcccaacgggtcctacggccccccgttcgggtcccacgttcccgttccgttcccccgtccccgttccctcccggtcctaccggtacgaccttaggacggtccgggtctaccgggg

SEQ ID NO: 101056 - DNA, 590 bp, Homo sapiens
  misc_feature: GYAE6OF01DS6PS.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaagcctggccaacgcccccaggaccactgatttatgataacaaacaaacaaacactcctcggacccctgcccggttctcagcctccgtcggtggggacaagctcgccctcgtacccgttcgggcgcgcgacgcctgaggatgaggctgagttatacgtgtcttgcttctctagtaggtggtggttcgggttgttcgggcggacggacgagtcgtgtaccgtcgtacggtcacggcccgaaggcctccgcccccgttcggtcctaccgtccgttccgttcccccgtccccttcccgtccggtacctaaccggttacgaccgtaggacgggccgggcgtacggg

SEQ ID NO: 101057 - DNA, 586 bp, Homo sapiens
  misc_feature: GYAE6OF01AQ6IR.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaacgcctggccaagccccccaggacactgatttatgatacaaacaacaaacactcctcggacccctgcccggttctcaggcctccctcggttggggcaagctcgccctgacccttcggtcgcgcacgcctgaggatgaggctgagtattacgtgtcttgcttctcctagtagtggttggttcgggtggttcggcgggacgggaccaagctcgaccgtccgtacggtcgacgccgaacggcctccggcccccgtcggtccaccttccgtccgttcccccacccctcccgtacccgtccgtttaaccgtacgtacgtcggacggtccgggtctaccgggg

SEQ ID NO: 101058 - DNA, 528 bp, Homo sapiens
  misc_feature: GYAE6OF01D59PR.15.5.A05.1.454.CMB.1.raw
  modified_base (361)..(361): a, c, t, g, unknown or other
  misc_feature (361)..(361): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaagctgccctgaccctttcggncgcagcctgaggatgaggctgagtattactgcttgcttctcctagtagttggtggttcgggtgttcggcggagggaccaagctgaccgtctaggtcacgcccaggctcgcccctggcacgtctcgttccccacccttcctcctactacgcctgagcgggctggaccg

SEQ ID NO: 101059 - DNA, 512 bp, Homo sapiens
  misc_feature: GYAE6OF01CYQ98.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccgttctcagctcctcgttggggcaagctgcctgacccttcggtgcgcagcctgagatgaggctgagtattactgtcttgctctcctatagtggtgttcgggtgtcggcggagggcagcgtgaccgtcgtaggtcagccaggctcgcccctcgtcactctcgtcccaccctcctcgctacgtacgactgcgcggcgtcgg

SEQ ID NO: 101060 - DNA, 527 bp, Homo sapiens
  misc_feature: GYAE6OF01BAIAO.15.5.A05.1.454.CMB.1.raw
  modified_base (491)..(491): a, c, t, g, unknown or other
  misc_feature (491)..(491): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgcccggttctcaggctcctcgttggggcaaagctgccctgacccttcggtgcgcagcctgagatgaggctgagtattactgcttgctctctatagtgtgttcggtgtcggcggaggaccaagcgtgaccgtcgtaggtcacgcccaaggcctcgcccctcggtccacgtcgtcgttcccnccctcctcgcttacgtacgactgacgcggcgtcggg

SEQ ID NO: 101061 - DNA, 545 bp, Homo sapiens
  misc_feature: GYAE6OF01AWI3Y.15.5.A05.1.454.CMB.1.raw
  modified_base (516)..(516): a, c, t, g, unknown or other
  misc_feature (516)..(516): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgataacaaacaacaaacactcctcggacccctgcccggttctcaggcctcccgtcggttgggggcaaagctcgccctgacctagtttcgggtcgcgcacgcctgaggatgaggctgtagtattactgtcttgcttctcctatagggttggtgttcgggtgttcggcggagggaccagctgaccgtcgtaggtcacgcccgaggcctcgccccgtcggtcctacgtcctcgttcccncccttcctcgctacgagactgcggcggcg

SEQ ID NO: 101062 - DNA, 579 bp, Homo sapiens
  misc_feature: GYAE6OF01BRR9Q.15.5.A05.1.454.CMB.1.raw
  modified_base (399)..(399): a, c, t, g, unknown or other
  misc_feature (399)..(399): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaacagaagcctggccaagcccccaggacactgattatgatacaaacaacaaacactcctacgaccctgcccgtctcagctccgtcgtgggcaaagctcgccctcgtacccgtttcggtcgcgcacgcgtgacggatgaggcgtgagttagttacngtcttcgctctcctagtaggtggttggttcgggtgttcgggacgggtacgggaccgaagtcgtcggacccgttcgtaggtccacggcccgaaggcctacgcccccgtcggtccaccgtccgtcgttcccccgcccttcccgtccgtcctaacggtcgtacgtagacggcggcggtacggg

SEQ ID NO: 101063 - DNA, 552 bp, Homo sapiens
  misc_feature: GYAE6OF01EQ2VY.15.5.A05.1.454.CMB.1.raw
  modified_base (445)..(445): a, c, t, g, unknown or other
  misc_feature (445)..(445): n is a, c, g, or t
tcagtctacgtagccacgaccggtgctcgatttagatagatagacaggggtcccgttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctcggacccctgcccggttctcgaggcctcccgtcgttcggggcaaacgctcgccctcgtacccgtttcgggtgcgcacgccctggagagtggaggcgtgagtattacgtgtcttgctctcctatagtggtgttcggtgttcggnggacggacagctcgaccgtctaggtcacgcccgaaggccgtcgccccgtcgccacttcgtcgttcctccgccctcctcgccttacgtacgaccgtgcggtcggtcgg

SEQ ID NO: 101064 - DNA, 950 bp, Homo sapiens
  misc_feature: GYAE6OF01B82CX.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctacgttggttaccaaacagaacgccctggacccaaacggcccccaaggaccaacctgtaatttagtgaacttaaccaaaaaccaaaacaaaaccaccttacccgtaccggtaaccccccttcggtaccccggtttcctaccgtacggtacccttccccggttccgggttacggggggacctaaaaggtccgtttacggcccccgtttacgggttaaccccccggtttttcgggggaccggtcccggtccggtaacggtccccgttagggaacgggtaacggttagggaacgggtccgttaagggttaaggtttaacgtttaaccgttcggtccttttcggtccccgtttacctttacccggtttaacgtttacggggtttcggggtttcggggtttttcccggggggtttacggggttttcccgggggaccgggggtttaaacgggggaaccccgttaaaacgggtcccggttaccgggtaacccccgggtttcccgggttaaaccggggtcccgaaccgggtacccccggtaaacgggggtccccttccccgggttacccccccggtttccgggtaccccgttaacccgtttccccgggtttaccccggttttacccccccaaccccccgtttccccgttaacccggttccccgtttaaacccgggttacggtaacccgttgggaaacccggggccggggttaccgtaaccggggg

SEQ ID NO: 101065 - DNA, 568 bp, Homo sapiens
  misc_feature: GYAE6OF01BW7RL.15.5.A05.1.454.CMB.1.raw
  modified_base (380)..(380): a, c, t, g, unknown or other
  misc_feature (380)..(380): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
tcagtctacgtagccacgaccggtgctcgatttagatagatagacaggggtcccttccaatatcagcaccatggcctggactcctctctttctgttcctcttcacttgctgcccagggtccaattcccaggctgtggtgactcaggagccctcactgactgtgtccccaggagggacagtcactctcacctgtggctccagcactggagctgtcaccaatggtcattatccctactggttaccaacagaaagcctggccaacgccccaggacactgattatgatacaaacaacaaacactacctggacccctgacccggttctcacggcctcccgttcggttggggacaaacgcctcgccctcgtaccccgtttgggtcncgcagccgtgaggagtgaggctgtagtacttactgtcttgtctctcttagtggttggtcggtttcgggtggtttcgggcggagggaccaaggtctacgaccgtcgtggtccacgaccgagcctccgcccgtcgtcactctcgttcccacccttccncgtctacgtacncgtagacggcggcgtacggg

SEQ ID NO: 101066 - DNA, 577 bp, Homo sapiens
  misc_feature: GYAE6OF01CYDWX.15.5.A05.1.454.CMB.1.raw
  modified_base (370)..(370): a, c, t, g, unknown or other
  misc_feature (370)..(370): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgccccaggacactgattatgataacaaacaacaaacactcctcgaccctcgcccgtctcgagcctccgtcggtggggacaagctcgccctcgtacccgttcggcgcgcncgcctggagagtgaggcgtgaagtattctgtcttgctctctagtgtggtggttcgggtgtcggcggacggacagtctcgaccgtcgtacggtcacgacccgaggtccgtcccgccccgtcggtcctaccgttccgtcccggttcccccaccccttcccgtccgtacgttaccgtacgaccgttgggaccgggtccgggtcgtacggg

SEQ ID NO: 101067 - DNA, 578 bp, Homo sapiens
  misc_feature: GYAE6OF01DIRDW.15.5.A05.1.454.CMB.1.raw
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcctactggttccaacagaagcctggccaagcccccaggaccactgatttatgatacaaacaacaaacactcctggacccctcgccgttctcagctcccgtcgttggggcaaagctcgccctcgtacccttcgggtgcgtcngcctgaggngtgaggctgagtattactgtcttgctctccttagtgttggtgtttcgggtggttcggcggagggacagctgaccgtccgtaggtcacgcccgaaggccgtcgccccccgttcgggtccctaccgttcccgttcgttccccctaccccttccctcccgtaccttaccggtacgtaacgtggacggtcgggtcgtacggg

SEQ ID NO: 101068 - DNA, 533 bp, Homo sapiens
  misc_feature: GYAE6OF01ATUM3.15.5.A05.1.454.CMB.1.raw
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaanagaagcctggccaagcccccaggacactgatttangatacaaacaacaaacactcctggacccctgcccgttctcagctccctcgttggggcaaagctgccctgacccgttcggtgcgcagcctgaggatgaggctgagtattactgcttgctctctatagtggtgttcggtgtcgcggaggcaagctgaccgtcgtagtcagcccaaggcctcgcccctggtccacgttcctccgttccccacccgttcctaccgcttacgtacgactcggacggccgggcgtcggg

SEQ ID NO: 101069 - DNA, 529 bp, Homo sapiens
  misc_feature: GYAE6OF01BORBH.15.5.A05.1.454.CMB.1.raw
  modified_base (492)..(492): a, c, t, g, unknown or other
  misc_feature (492)..(492): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaatagaagcctggccaagcccccaggacactgatttatgatacaaacaacaaacactcctgacccctgcccggttctcagctccctcgttggggcaagctgccctgaccctttcgggtgcgcacgcctgaggatgaggctgagtattactgtcttgctctcctatgtggtgttcggtgtcggcggaggacagcgtcgaccgtccgtaggtcgacgcccagcctcgccctcgtcctactcgtccgttcccnccctcctccgctacgtacgactgacggcggcgtacgg

SEQ ID NO: 101070 - DNA, 830 bp, Homo sapiens
  misc_feature: GYAE6OF01BUTNY.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactgtcgtcccaggagggacagtcactctcactgtgctcagcacgtggagctgtacgaaccaagttggtactaactttactcccttacgttcggttaccaaacgaggaacgtccctacgggacccaaccggccccccgaaggtaacctaaccgttaggtaattttacgtaggtaaacctaaaccaaaaaccaaaaccaaaacctaaccgtacccgtaccggtaacccccgttcggtaccccggtttcctaccgtaccgggtcccttcccggttccggggttacgggggaccaaaacggtccgtaccggtaccccgttccggttaccccggtttcggggtcgccggaccgtacggtcccggtaggacggttagacgggtacggtacgttaggtaacgtttaacgttaccgtgttaccgtttacgtcccgttccgttaaccgtttaggttacgggtttacggggtttcgggtttaccgggggttcggtttacccggggacgggtaaaccgggaccgtaacgggtccgtaaccggtacccggtcgtacgggttacgacccggtaccgaacggtcccgtcccggtcccccgtaggtccctaccgttccgttacccggtcccctcccgttccgaccgttccgtaacggttcgacggtggacgggtccggcgtaacggg

SEQ ID NO: 101071 - DNA, 608 bp, Homo sapiens
  misc_feature: GYAE6OF01DL6J4.15.5.A05.1.454.CMB.1.raw
  modified_base (601)..(601): a, c, t, g, unknown or other
  misc_feature (601)..(601): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggcctccagcactggagctgtcaccaatggtcattactccctactggttaccaacagaagcctggaccaacgcccccaggaccactgatttatgatacaaaacaacaaacactcctcggaccctcgcccggttctcacggtcctcccgtcggttcgggggacaaagccgtcgcccgtcgtaccccgtttcgggtcgcgcgacgtccgtaggaggagtgacggtcgtagtagttacttacgtgtcttcgcttctacctagtggttggttcggtttcgggtggtcgggcggtagggacaggtcgtacgaccgtcgtaggtcacggtaccgaacggctccgccccgtcgtcctacgtcgttccgttccccgccctccgtccgcttaccggtacacggtggacggtccgggntaccggg

SEQ ID NO: 101072 - DNA, 752 bp, Homo sapiens
  misc_feature: GYAE6OF01D4TY1.15.5.A05.1.454.CMB.1.raw
tcagtctacgtagccacgaccggtgctcgatttagatagatagacagggtcccttccaatatcagcaccatggcctggactcctctctttctgttcctcctcacttgctgcccaggtccaattcccaggctgtggtgactcaggacgccctcactgactgtcgtcccgaggaggacagtcactctcacctgtcgctccagcacgtggagctgtacaacctaagtggtactattaccgtacccttaacgttcggtttacccaaagacgaacgcctacggacccaaccgcccccaaggacctaccgtagtactttagtacaactaaaccaaaacaaacaaaacgacctaccgtccgaacccctcgtcccgttctacgacgccttacccgtcgggttacggggaactaaacgtcgtccgcccgtacggtccccgtttcgggcgaccgcgacgccgttaggaaggtcgtacggaggtcttaggaacgtttacgtttacttggtcctttagccctttactaccgttagttacgggtttggttcgggtttcggttacggtttaccgggacggggttaacgggaacccgaacggtccgttaccgtaacccggttaccgtacgggtaccgttaccgaaccccgggtaacgtccgtccccgtaacccccggttcgtaccgtaacccgttcccgttcgttaccccccctaccgtcccgtaccgtacccgttacgtcgtaacgtggacgtcgggaacgtcggg

SEQ ID NO: 101073 - DNA, 535 bp, Homo sapiens
  misc_feature: GYAE6OF01A6HK6.15.5.A05.1.454.CMB.1.raw
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgataacaaacaacaaacactcctcggacccctgcccggttctcacggctccgtcgttggggacaagctcgcctgtacccgttcgggtcgcgcagcctgacggagtgaggctgagttacttacgtgcttcgctctctagtagtggttgttcgggtgttcgggcggaggacagcgtcgtaccgtctaggtcagcccaggctcgcccctgtcactcgtcgttcccacctccncgtctacgtcgactgcgcggngtcgg

SEQ ID NO: 101074 - DNA, 720 bp, Homo sapiens
  misc_feature: GYAE6OF01D9IXX.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgatttatgatacaaacaacaaacactcctcggacccctcgcccggttctcgacgctcccgtcgttggggacaacgctcgccctcgtacccgtttcgggcgcgcacggcctggaggatggacggtctagagttattactcgtctttgtcttccttaccttagttacggttggggtttcggtttcggggttcgggtttccgggaccggggtaacgggtaacccgtaagtccggttacggaccccggttcccgttaacggggttacccgaaccggtaccccgtaaacgggtcccgttaccccggtccccccccggttcgggttccccgtaacccgtttcccgttacccgtttcccccctaaccccccgtttcccggttaccccggtcccgtttaaacccggtacggtaacccgttacgggaccgggtcccgggggtccgtaccggggg

SEQ ID NO: 101075 - DNA, 703 bp, Homo sapiens
  misc_feature: GYAE6OF01AYP99.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggttccaaacagaacgcctggcccaacgcccccaaggacactcgtatttatgataacaaaacaacaaacactcctcggacccctgtcccgttctcagcctccgtcggttggggacaacgtccgtcgccctacggtacccgtttgggcgccgcacggtccgtaggacggtagtggacggtctagggtaatttacgttacgttgtccgtttcggtccctttacttcccttaaggttacggttggggtttcgggttttacggggttcgggtttaccgggggcggggtaacgggtaaccgaacggtccgtacggtacccgttacgtacggtccgaacgtacccgacggtccgtcccgtccccgtcggtcctacccgttccgttcccgttacccccgtccccgttcccgtacccggttacccgttaaccggtacggtaccgttagggaccggtccggggtcggtaccggg

SEQ ID NO: 101076 - DNA, 800 bp, Homo sapiens
  misc_feature: GYAE6OF01CM3RH.15.5.A05.1.454.CMB.1.raw
  modified_base (148)..(148): a, c, t, g, unknown or other
  misc_feature (148)..(148): n is a, c, g, or t
  modified_base (244)..(244): a, c, t, g, unknown or other
  misc_feature (244)..(244): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcagganccctcactgactgtgtccccaggagggacagtcactctcacctgtggctccagcactggagctgtcacaatggtcattactcctatggttaccaanagaagctcgaccaacgccccaggacactgtattatgataacaaacaacaaacactcctacggacccctagcccggttctacgacggcctccgtcggttcggggacaaaggtcctacgtccctacggtacccgtttcgggtcgaccgtaccacggtcccgttaggacgggaacgttcggaacgggtcgttacggtaacggtttaacgtttacgtcggttccgtttagaccccgtttacttacccgtttaaggttacgggtttacggggttttcggtttaccgggggtttacggtttacccgggggaccggggtaaccggggtaaaccgtaaacggtccggtttaaccggtaaccccgggtttcccggttaaacgggttccccgaaaccgggacccccgttaaacggggtcccttaccccgggttaccccccgttaccggggttacccttaacccgttcccggtttaacccggtttaccccccacccccggtttcccgttaccgtacccgtttaacggtaccgaacccgttagggaccggtcggggtcctaaccgggg

SEQ ID NO: 101077 - DNA, 685 bp, Homo sapiens
  misc_feature: GYAE6OF01C9FR8.15.5.A05.1.454.CMB.1.raw
  modified_base (399)..(399): a, c, t, g, unknown or other
  misc_feature (399)..(399): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcaattactccctactggttccaacagaagcctggaccaacgccccgagacactgtacttatgataacaaacaacaaacactcctacgaccctcgacccggttctcgacgtcctccgtcggtaggggacaagctcgaccctcgtacccgtttcggcgcgcgacgccgtggacgtagnggacgtacgttgaagttacgttactcgtacgttcgtccttcgttaccgttaagttggttcgggtttcggtttccggggtttcggttcggggtaccgggtaacgggtaaccgtaacggtcggttaaccgtacccggttaccgttacgggttcccgaaccggtacccggtaacggtccggtacccgtccccccgttcggtaccctacccgttccgttacccggttaccccctccccgttccgtcccgtacggttacgtacgtacgtcgaccgggtcgggtcgtacggg

SEQ ID NO: 101078 - DNA, 861 bp, Homo sapiens
  misc_feature: GYAE6OF01DRUTQ.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtcgtcccaggaggacagtcactctcacctgtcggctccagcacgtgggacgtctcggtaccaaccgtaagttcggttactaactttacgtaccccttacgttcgggttacccaaacgaacggaaccgtcccgttacgggacccaaaccggcccccgaaaggaacctaaccgtaggttaatttaacgtacgtaactaaaccaaaaaccgaaaaccaaaacctaccttacccgtaccggtaaccccgttcggtaccccgtttctaccgtacggtcccttaccggttacgggtacggggacaaacgtccgtacggtccccgttacggttaccccggttggggtccgacggacgtacgtcccggtaggtacgggtacgtacgggacgtcgttacggtaacgtttacgtttagtccggttacctttcgggtacctttaccgttacgttaacgggtttacgggtccggggttttcgggttttacggggtttacccgggttcgggggaccgggttaacgggaccgtaaccgggtttccgggtaccgttaaccccgggttaccgttacgggacccgtaacccgggtacccgtaaccgggtccctccccggttccccgttacgggtacccttaccgtcccgtttcccgttacccccgtacccttccgtccgtacccgttacgtacgtcgaggtccgggcgtacggtcggg

SEQ ID NO: 101079 - DNA, 538 bp, Homo sapiens
  misc_feature: GYAE6OF01E2UOE.15.5.A05.1.454.CMB.1.raw
  modified_base (459)..(459): a, c, t, g, unknown or other
  misc_feature (459)..(459): n is a, c, g, or t
  modified_base (507)..(507): a, c, t, g, unknown or other
  misc_feature (507)..(507): n is a, c, g, or t
  modified_base (533)..(533): a, c, t, g, unknown or other
  misc_feature (533)..(533): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttcccaaacagaacgcctggccaacgcccccaggaccactgatttatgatacaaacaacaaacactcctcgaccctcgcccggttctcacggcctcccgtcggttgggggcaaacgctcgccctcgcccgtttcgggtcgcgcacgcctgaggatggaggcgtgtagtattactgcttgctctctagtagtggtgttcgggtgtcggcggaggaccagcngaccgtcgtaggtcacgccgagctcgcccctgtccactcgtcgtcccnccctcctcgctacgtagctgcgcggngtcgg

SEQ ID NO: 101080 - DNA, 704 bp, Homo sapiens
  misc_feature: GYAE6OF01CK0EP.15.5.A05.1.454.CMB.1.raw
  modified_base (248)..(248): a, c, t, g, unknown or other
  misc_feature (248)..(248): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtcggctccagcacgtggagctgtcaccaatggtcattactccctatcggtaccaanagaacgcctggaccaacgcccccaaggacactgtattatgataacaaacaacaaacactaccgtacgacccctggcccgttctcgacgcctcccgtcggtacggggactaacgtccgtcgccctcgtacccgtttcgggtcgcgtcgacgccgtaggacggatcggacggtcgtaggagttactttacgtgtccttcggtcctttaccttccgtaagttcggttgggttcgggtttcggggtttcggttcgggaccgggtaacgggtaccgaacggtccgttacggtacccgttaccggtcggtaccgaccggacccggtaacggtccctacccggtcccccgttaccgggtcccttaccgttcccggtttcccgttcccccggtccccgtttccccgtaccggtcccgttaaacggttcgtaaccggacggtacggtccggggtccgtaccgggg

SEQ ID NO: 101081 - DNA, 694 bp, Homo sapiens
  misc_feature: GYAE6OF01C9M76.15.5.A05.1.454.CMB.1.raw
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattactccctactcggttccaacagaagcctggccaacgcccccaggaccactgatttangatacaaacaacaaacactcctcggacccctgcccggttcncagcctccctcggttcggggacaagctcgcccctcgtacccgtttcgggtcgcgcacgccgtggacggtagtggaggctggtaagttacttactgtcttcgcttcctccttagtacggttgggttcggtttcggggttcggttaccgggacggggtaacgggaacccgtaacggtcgtacggtacccggttacccgtagggttacccgaccggtaccccggtaaacgggtccctacccggtccccccccgttcgggttacccctacccgtttcccggttcccggtttacccccccgtcccccgtttccccgtccccggttccgttaaccggtacgtaaccggtggaaccggggtccggtccgtaccgggg

SEQ ID NO: 101082 - DNA, 563 bp, Homo sapiens
  misc_feature: GYAE6OF01DV50S.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatgtcattatccctactggttccaacagaagcctggccaacgcccccaggacactgatttatgatacaaacaacaaacactcctcggacccctcgcccggttctcacgctcccgtcgttggggcaaagctgcctgaccctttcggtcgcgcagcctgaggatgaggctgagttattacgtgtacttcgcttctcctagtagttggttgtttcgggtgttcggcgggacgggacaagcgtcgaccgttccgtaggttcacgcccgaaggccgtcgtcccccgtggtccacgttctcgttacccacccctcctccgccttacgtacgactggacggcggcgtacggg

SEQ ID NO: 101083 - DNA, 883 bp, Homo sapiens
  misc_feature: GYAE6OF01ASOEF.15.5.A05.1.454.CMB.1.raw
  modified_base (297)..(297): a, c, t, g, unknown or other
  misc_feature (297)..(297): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtcgtccccgaggaggacagtcactctcacctgtggctccagcacgtggagctgtacaccagtggtcattactccctacgtcggtaccaacagacgccgtcggacccaaccgccccgaaggacctacgtagtatttanagaataaacaaaaccaaaccaaacctacctacccgtaccggaccccgttccggtcccgttccaccgtacgtcccgttcccgttcgggtacggggactaaacggtccgtccgacccgttccggttacccggttcggggtacgccggtcgaccggtccgttagggaacggtacgtaggacggtcgttaggtaacgtttacgtttaccgttacgttccgtttacgtacccgtttaccttaccggtttaaaggtttacggggttttcggggtttaccggggttttccgggggttacgggtttccggggaaccggggtaaccggggtaaccgtaaaccgggttccgggtaacccggtaccccggttaccggttacggggtaccccgtaaccgggtaaccccggtacccggtaccccggttcccccggtaccccccggtttaccgggtaccctttaccccggttaccccgtttcccccgttacccccccgtaccccggtttaccccgtaccccgggttaacccggttaaacccgggttaccggttaaccgggtaccggggtaccggggtcccgggttaacgggtacccgggg

SEQ ID NO: 101084 - DNA, 806 bp, Homo sapiens
  misc_feature: GYAE6OF01A9PNW.15.5.A05.1.454.CMB.1.raw
  modified_base (315)..(315): a, c, t, g, unknown or other
  misc_feature (315)..(315): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtcggcctccagcacgtggacgcctgtacaccaagtcggtacctatttacctcccctacgttcggttaccaaacgagaacgcctacggacccaacgtcccccgaaggacctacgtagtatttanagtaactaacaaacaacaaacctacctaccgtaccggtaccccgttcggtaccccggttactccgtacggtcccgttacccggttacgggttcggggaccaaacggtccgtaccgtcccgttacggtaccccggtttcggggtacgtccgtaccgtaccggtaccgtacgggtaacgggttacgtcgggtaacggttcgttacggttaacggttaacgtttaccggtcggttccgtttcggtacccttaccgttaacccgttaggttacgggtttcgggtttccggggtttacggggttcggtttaccggggacgggtaacgggaacccgtaaggtccggttaccggtaacccggttccggtacgggtaccgtaaccggtaccgtacgggcccgtacccggttcccgtcggtacccgtcccgttcgttccccggtaccctcccgttccgtccgtaccgttacggacgtcgtacggcggtccggcggtacgg

SEQ ID NO: 101085 - DNA, 746 bp, Homo sapiens
  misc_feature: GYAE6OF01BTJPL.15.5.A05.1.454.CMB.1.raw
  modified_base (376)..(376): a, c, t, g, unknown or other
  misc_feature (376)..(376): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctggtggtgactcaggacgccctcactgactgtcgtccccgagggagggacagtcactcctctaccgtgtcggctccgagctacgtggacgtctgtaccaacctaagtcggtacctatttacctccccgttacgttacggttaccaacgagaacgccgtcggaccaaccgccccgaggaccactgtattatataactaacaaaacaacaaacctactaccgtaccggtacccgtcggtcccgttcncgacgtcctcccggtcggtacgggactaacgccgtccgtccgtcgtacccggttcggcgtaccgcgacgtcgtaggacggagtggtacgtcgtacgtagtacgttacgtacgtcgttcgtctcgtacgtacgttacggttcgggttcgggttcgggttcgggttcgggacgggtacggtaacgtacgtcgtacggtaccgtaccgtacggtaccgaccggtaccgtaccggtcccgtaaaaaaaacccgtccccggtaccgttaccgtaccgttcccgttcccgttaccccgtaccccgttcccgttacccggttacccgttacccggttaccggtaccggtacggtaccgggtccgggtcggtaccggg

SEQ ID NO: 101086 - DNA, 839 bp, Homo sapiens
  misc_feature: GYAE6OF01EFIS0.15.5.A05.1.454.CMB.1.raw
  modified_base (102)..(102): a, c, t, g, unknown or other
  misc_feature (102)..(102): n is a, c, g, or t
  modified_base (141)..(141): a, c, t, g, unknown or other
  misc_feature (141)..(141): n is a, c, g, or t
  modified_base (788)..(788): a, c, t, g, unknown or other
  misc_feature (788)..(788): n is a, c, g, or t
tcagtctacgtagccacgaccggtgctcgatttagatagatagacaggggtccttccaatatcagcaccatggcctggactcctctctttctgttcctcctnaccttgctgcccagggtccaattcccaggcctgtcggtnactcaggagccctcactgactgtctcccaggaggacagtcactctcacctgtggctcagcactggacgctggtccacctaagtcgggtacatttaactccccttaactgggttaccaaacgaggaaacgtcccttaggacccgtaacggccccccaagggacctactacggtaattttacgtcggtaacttaaccaaaaccgaaacaaaacctaccttaacccggtacggtaacccccgttacggtccccggtttaccttccgaaccgggtccttacccgtcggttcgggggactaaacgcgtccggtccccgtacgtaaccccgtttggggccggtaccgtccgtaacggtacccttgggacggtacgtacggaaacggtccttagggttacgttaacgttttaacgtcgggtacttttcgggtacccttaccgtttaccgttaacggttttaacgggttcgggtttccgggttttaacgggggttaccggggtttccgggggtaacccggggttaaggggaacccccggtaaacgtccgggttacgttacccccgggttacggtttaccgggacgaccgttaccccgacggttacccggacccgttaccccggtccgttaccgtaccgtccgttccgttaccccncccgtccgtcccggtactacggtaccacggtacgcggtacggcggtaccgg

SEQ ID NO: 101087 - DNA, 842 bp, Homo sapiens
  misc_feature: GYAE6OF01DF84T.15.5.A05.1.454.CMB.1.raw
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctnactgacctgtcgcccgaaggnggacagtcactcncacctgtcgctcagcacgtgganctgacaaccaagtcggtactaacttactcccttacgtcggttacccaaagtacggaacgaccgtcggaccaaccgaccccgaggacgtacctagtattatagaactaacaaaacaaaccaaaacctacctaccgtaccgtaccccgtaccggtacccggttaccgtacgtacggtacccgttcccggacggtttttttacgggacgtaaacgtccgtaccgtacccgtaccggttacccggttccgggtacggtacggaccgtacggtaccggtacggtaacgggtacgtacgggtacgggtaccggtaacggtaacggttaaccgtttaaacgttaccggttccgtttaccgttacccgttaccgtttaacccgttaacggtttaacgggttacggggtttaacggggtttcccggggtttacggggtttaccggggtaccggggtaacgggtaaccggtaaccggtaccggttaccggtaacccggttacccggtacggttacccggaaccgacccggtaacggtacccgtcccggtaccccgttccgtacccgtacgtaccgttcccgttcccgtcccgtcccgtaccgtacgtacgtacggtacgtagaccggtcggtcggtaccggg

SEQ ID NO: 101088 - DNA, 641 bp, Homo sapiens
  misc_feature: GYAE6OF01EPUWW.15.5.A05.1.454.CMB.1.raw
  modified_base (442)..(442): a, c, t, g, unknown or other
  misc_feature (442)..(442): n is a, c, g, or t
tcagtctacgtagccacgaccggtgctcgatttagatagatagacaggggtcccttccaatatcagcaccatggcctgggctcctctctttctgttcctcctcacttgctgcccagggtccaattcccaggctgtggtgactcaggagccctcactgactgtgtcccaggaggacagtcactctcacctgtgctccagcactggagctgtcaccaatggtcattactccctactcggttccaacagaacgcctggcccaaacgcccccaaggacacctgtatttatagataacaaaacaacaaaaccacctaccctacggacccctacggccccggtttactcgacggcctcccgtcggttcggggacaaacggtcctcgccctgtaccccgtttcgggtgcgcgacgtcctggaggagtgaggctagacgttactttacgngtccttgcttctactagtaggtgggttcgtttcgggtcgtttcgggacggtagggtacccgaagtcgtcgtaacccggtcgttaggtccacggcccgaaggtcctccggccccgtgtaccctacttccggttcccgttccccgcccgttccgtaccgtcctaacggttacgaccgttacgggcgtccgggccgtacggg

SEQ ID NO: 101089 - DNA, 654 bp, Homo sapiens
  misc_feature: GYAE6OF01E31BO.15.5.A05.1.454.CMB.1.raw
  modified_base (316)..(316): a, c, t, g, unknown or other
  misc_feature (316)..(316): n is a, c, g, or t
  modified_base (415)..(415): a, c, t, g, unknown or other
  misc_feature (415)..(415): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtcgtccccaggagggacagtcactctcacctgtggctccagcacgtggagctgtcaacctaatggtacattactccctagttggttaccaacgagaacgcctcggaccaacgccccgagacacgtgtattatgataaccaaaacaacaacactccncgaccctcgccgtctcgacgtcctccgtcggtgggacaacgctcgcctcgtacccgttggcgcgcgcgctggacgagtgagcgtaggtactacttacgngttacgttcgcttcgtactagttacggtcgggtttggttcgggttcggtccgggacgggacggtaaccacgtccgtcgtaccggttacgtcggtacgaccgtacccgaaggtccctacccggtcccccgttcgtacccgtaccgttcccgttcccggttccccctcccgttcccgtacccgttacccgttaacggtaaccgtacgggttacggtaccgggtcccgggcgtaacccgggg

SEQ ID NO: 101090 - DNA, 869 bp, Homo sapiens
  misc_feature: GYAE6OF01AURM8.15.5.A05.1.454.CMB.1.raw
tcagtctacgtagccacgaccggtgctcgatttagatagatagacaggggtcccttccaatatcagcaccatggccgggggtggactcctctctttctgttcctcctcacttgctgcccagggtccaattcccaggctgtggtgactcaggacgccctcactgactgtcgtccccgagggagggacagtcactctcaccgtgtcggctccagcacgtggagtctcgtcaaccaagttcggtactaattacctaccctacgttcggttaccaacagacgcctggccaacgccccaggacactgatttatagtataaccaaaactaacaaacctacctacctacggaccccctggtccccgttctccgacggccttcccgtcggttaggggaccaaacggccgtcgaccccgttcggtaccccgtttcggggccgtcggtccgtaacggtcccgtagggaacggtagtcggaaacgggtcttagggtagtttaacggtacgttacggtcgtttgtcccgttaccttaccgttagttacgggttacggggtttcggggttttcggggttcgggttacccggggtacgggggtaaaccgggtaccggtaaacgggtacccgttaaccggtaaccccggtttacccggttaacggggtacccggtaacccgggaccccgggtaaaccggtccccggggtttacccccgtaccccccgggtttacccgggttacccgtaaccccgtttccccggttttacccccggttaacccccgtttaaccccccccttccgggtttacccctacccggttttaaccccggtacgggttaccggtcccggaaccgggggtcccgggtacggtaaccccggggg

SEQ ID NO: 101091 - DNA, 719 bp, Homo sapiens
  misc_feature: GYAE6OF01DO2IS.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtcccaggaggacagtcactctcaccgtgtggctcagcactggagctgtcaccaatggtctattactccctacgtcggttaccaacagaagccgtggacccaacgaccccacggactactagtattatagactaacaaaacaaacaaaccactacccgtacggacccctcggtcccggttctccgacggtcctcccgtcggtgggacaagctcgccctcgtacccgttcggcgcgcacgctgagagtcgaggcgtagtagttacttacgtcgtcttgtaccttctacgttagttacggttgggtttcgggtttccggggttgggtttccggggacgggtaacggggtaaccctaacggtccgttaacggtaccccgggttaccgttacgggttccgaaccggtacccgaacgggtcccgtacccggtaccccccgttcggttacccgtacccgttcccgttttacccggttacccccccttaccccgttcccgttaccggtacccgttaaccggttacgtaaccggtgggtaaccgggccggggtccgtaccgggg

SEQ ID NO: 101092 - DNA, 729 bp, Homo sapiens
  misc_feature: GYAE6OF01DDA31.15.5.A05.1.454.CMB.1.raw
  modified_base (256)..(256): a, c, t, g, unknown or other
  misc_feature (256)..(256): n is a, c, g, or t
  modified_base (359)..(359): a, c, t, g, unknown or other
  misc_feature (359)..(359): n is a, c, g, or t
  modified_base (720)..(720): a, c, t, g, unknown or other
  misc_feature (720)..(720): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggcctccagtcactggagctgtacacctaatgtctattactccctacgtcggttaccaaagngaacgccgtcggaccaaccgccccgtaaggaccactagtattaactagaactaacaaaacaaacaaaccacgtacccgtacggaccccgtacgtccccggttnaccggtacggtccttaccccggtcgggttcggggaacaaacgccgttacgtcccgtacggttaccccgtttcggggcgtacggaccgtaacggccgttaggaggtagacgtacgggactttaggaacggttatacgttgttccgtacggtcccttcgttaacctttaaggtcggggtttcgggttaggggttttcgggtttccggggtaccggggtagggaacggtacccgaaggtcgtaccggtacccgttaccggtaaggtcccgaaccggcccgtaaggcccgtcccgtaccccgcgtacctaccgttcgtacccgtcccctaccgtcgtcccgtacggtactagacgtggaccgggnggactacgg

SEQ ID NO: 101093 - DNA, 842 bp, Homo sapiens
  misc_feature: GYAE6OF01EWXE8.15.5.A05.1.454.CMB.1.raw
  modified_base (220)..(220): a, c, t, g, unknown or other
  misc_feature (220)..(220): n is a, c, g, or t
  modified_base (508)..(508): a, c, t, g, unknown or other
  misc_feature (508)..(508): n is a, c, g, or t
  modified_base (550)..(550): a, c, t, g, unknown or other
  misc_feature (550)..(550): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactggtcgtcccgagggagggacagtcactctcaccgtggtcggcctaccgagccacgtggancgtcgtaccaaccgtaatcggtactactttacctcccgttagttaccggttaccaaacgaacggtaaccgccgttacggacccaacccggacccccgaagggaacctaccgttaggttaacttttagtaacgaacttaaccaaaaactaaaaccaaacctacccgttccgtacccggacccccgttaccggtcccccgtttactaccggacggtcccgttacccggtcgggttacggggaaccaacgtccgtaccgtcccgtaccgttcccggttcgggcgtccgacncgtcgaggagtagtcggagtcgtaggtattacgttagtcgtnttcgtcttccgttacgtaaggtttggtcggggttttcggtttccgggttgggttacccgggacgggggtacggtaaccgttaggcccttagggtacccccgttacggtacgggttaccggaacccggtacccgtaacgggtcccgttacccccgtaccccggttaccgggttcccctaaccgggttccccgtttcccccgggtcccccccgttcccgttaccccggttcggtaacccgttaccgggtaccggttacacccggggtaccggggtcccgtaggggtaacccggg

SEQ ID NO: 101094 - DNA, 713 bp, Homo sapiens
  misc_feature: GYAE6OF01CKLFN.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtcccaggaggacacgtcactctcacctgtgctccagcacgtggatctgtcaccaatgtactattactccctacttggttaccaacacgaacgtcctacggaccaaccgcccccgaaggaccactagtattatcgaactaacaaacaaacaaacactcctcggacccctcggtcccgttcgcgtcggtcctcccgtcggttcgggacaacgctcgcccgtcggtacccgttcgggtcgcgacgcggccgtaggacgagtcggacggtcgtagtacgttaacttacgtcgtacgttcgtcttactcggttatagggttgggttcggtttcggggttcggtcgggacggtaacgggtaccacggtcgtacggtacccgttaccggtaggtcccacggtaccggaaccggtcccgttacccggtcccccgttacccgggtccgttacccgtttcccgttccccgttaccccgtaccccgttcccgttacccgtacccgtttaaccgggtaccgttaccggtacgggtacccgggtccgggcccggtaccgggg

SEQ ID NO: 101095 - DNA, 797 bp, Homo sapiens
  misc_feature: GYAE6OF01D0QCG.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtcccaggaggacagtcactctcacctgtgctccagcagtgatcgtcgtacaactagtcgtactaactttacctacccttacgttacggttaacccaacgtaacggaaccgtccgtaccggaacccgaaccccggaccccgaggaacctacgttagttaatttagacgaaactaaacaaaaccaaaacaaacctacctacccggtaccggtaccccgtccggttacccgttctaccgaccgtcccgttcccggttacggggtacgggaaccgtaacgtcccgtaccgtacccgttaccggttcccggtttcgggccgtacccggtaccgtaccggtacggtagggacggtaggtcgggaacgttcggtaagttaacgtttaacgttacgtcgtacgtttccgtaccctttacgttaccggttaaggtttcgggttttcgggtttcggggtttacggggttcgggttaccggggacggtaaccggtaacgaacggtccgtaccggacccgttacggtacgtaccgaccgaccggtacggtcccgtaccccgtcccgtagtacccctcgttaccccgtcccgttacccctaccgtccgtccgtaacgtacgtacgacgtcgggcggcgtcggacgg

SEQ ID NO: 101096 - DNA, 826 bp, Homo sapiens
  misc_feature: GYAE6OF01BQDOR.15.5.A05.1.454.CMB.1.raw
  modified_base (210)..(210): a, c, t, g, unknown or other
  misc_feature (210)..(210): n is a, c, g, or t
  modified_base (340)..(340): a, c, t, g, unknown or other
  misc_feature (340)..(340): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtcccaggaggacagtcactctcacctgtcgctccagcacgtggancttcgtacaacctaagtcggtactaacttacctcccgttaacgttccggttaaccaaactaggaaccgtccgtacggaaccccgaaccggaccccccaagggtaacctaccgttaagtatttttaacganaaaccttaaacgaaaaacccaaacctaaaaccgtaccttacccggtaccgtaacccccggtcggtaccccgtttacgaccgtacggtcccctttacccggtcggggttacgggaacctaaacggtcctaccggcccgttaccgttaccccggtttcgggccgtaccgacgtaccggtccgtagggtaacgtaggtaccggaggttaaccggttagggtaaccgttttacgttaacggtttccggtaccttttaccggtacctttacccgttaacgtaggtttacggtttcgggttaccgggtttcggggttacggtcggggacggtaacggacggtacgtacgttaccggtaccgtacggttccgtacgaccgtacccggacgtccctccggtaccccgtctaccgtaccctccgttacccgttcccacccgttcgcccgtacgttaccgtacggacgttagggacccggtgggtaccgtaccggg

SEQ ID NO: 101097 - DNA, 944 bp, Homo sapiens
  misc_feature: GYAE6OF01CCX75.15.5.A05.1.454.CMB.1.raw
  modified_base (447)..(447): a, c, t, g, unknown or other
  misc_feature (447)..(447): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtcccaggacgggacagtcactctcacctgtcgctccgagtcacgtggagcgtagtaccaaccgtaagttggtactaatttacctacccttacgttcggttaaccaacgaaggaacgtccgtacgggaccaaccggcccccgaagggtacctaaccgttaggttaaactttttaggtaccgtaaacttaaaacccgaaaaaaccgtaaaaccgaaaaacctaacccgttaccccggtaacccggggtaaaccccccgttaccgggtcccccgggttttaaccnccgggtaaccgggtaccccgtttaccccggtttcgggggtttaccggggggaaaacctaaaaccgggtccgttaccgggttcccccgttacggggtttaacccccggttttcgggggtaccgaccggttaccggaaccggtccggttagggaaacggaccgttagggtaacgggtcgttaggggtaacgttaaccgttttcggacgttccggtttacggtacccttacccgtttaaccgttaaaggttcgggtttacggggtttcggggttttaacgggttccgggttaccggggacgggttaaccgggtacgtaacgggtccgtaccggggtaacccgttaccggttacgggaaccctaccgggtaccccgtaacgggtcccctcccggttacccccggttcgtacccgttccgttccgtacccgtttcccccggtaccctcgtacccgtccggaaccgttacggaccgtacgggaccggtcgggcgtaaccgggg

SEQ ID NO: 101098 - DNA, 862 bp, Homo sapiens
  misc_feature: GYAE6OF01CIA5P.15.5.A05.1.454.CMB.1.raw
tcagtctacgtagccacgaccggtgctcgatttagatagatagacagggtcccttccaatatcagcaccatggcctggactcctctcgtttctgttcctcctcacttgctgcccagggtccaattcccaggctgtggtgactcaggacgccctcactgacctgtcgtccccgaggacgggacagtcactctcacctgtcggctccagtccacgtggacgctcggtaccaaccaagtggtcctaatttaccttcccctacgttcggttacccaacgtacggaacgtcccgtaggaccaaccggaccccccaagggaaccctaccttcggtaattttaacgtacggtaactaaaccaaaaaccgtaaaaccaaaacctaccgttacccgtaccggaaccccctcggttacccccggtttataccggtaccggtccccgttacccccggttcggggtacgggggaaccaaaccggtcccgttccggccccgttacggtcccccggtttcggggtaccgcccggtaccaccgggtcctcgggtaacggacggttacgggacggtacggttaaccggttagttaacggtttacccgttcgttaccgtttcccgtacgtttcccgttaactttagggttaccgggtttgggttaacgggtttccgggtcgggttaccggggtacggaaccgggtaaccgtaccggtcccgtaccggtacccgttccggtaaccgtccgaacggtacccgacggtccccgtaacccggtccccgtaccggtcctacccgtccctttaccccggtacccctccccggttaccctcccgtaccgaccggtatacccgggtacgacggtccggtcgtaccgg

SEQ ID NO: 101099 - DNA, 716 bp, Homo sapiens
  misc_feature: GYAE6OF01CI91W.15.5.A05.1.454.CMB.1.raw
  modified_base (323)..(323): a, c, t, g, unknown or other
  misc_feature (323)..(323): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtggctccagcactggagctgtcaccaatggtcattactccctactggttaccaacagaagcctggaccaacgccccaggacactgattatgatacaaacaaacaaacactccacggaccctcgcccggttcncgacgcctcccgtcggtcggggacaagctcgccgtcgtacccgtttcggtcgcgcacgccgtgaggagtggacggcgttagagttaagttacgtgtcgttacgcttccttacctagttacggttggttacgggttcggggttcggtttcgggaccggggtagggtaacccgaaggtccgtacggtaacccgttccgttaacggggtacaccggtaccccggtaagggccccgttacccggtcccccccgtttaggtccccgttaaccgtttccccggtttccccggtttccccccggtcccccctttcccgggttacccggtaccccgtttaacccgggttaaccggtaccgtacgggtacccgggggtacccgggtccggtaaacccggggg

SEQ ID NO: 101100 - DNA, 1017 bp, Homo sapiens
  misc_feature: GYAE6OF01BTSXT.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctggtggtgactcaggacgccctcactgactgtcgtcccgaggacggacagtcactctcacctgtcgctccagcacgtggacgtctcgtaccaacctaagtcggtactacttaccgtcccgttacgttcggttaccaaacgtaacggaacgtcccgtacggacccaaaccggaccccccgaaggtacctaacgttggttaacgttttaacgtacggtaaactaaaaccaaaaaacctaaaaccgtaaaacccgtaccttaccccggtacccgggtaccccccgttaccgggtaacccccggtttccgtaccggtaaccgttccccggttccccgggtttcggggttaaccgggggaaccgtaaaccggtccgttcccggtaccccgtttacccgggtttaccccgggttttccggggtaccggtcccggtaacccggtaccggtacccggttacggggtaaacgggtacggtttaacgggtaacgggtaccgtttaaggggttaaccgttttaccggttttaaccgtttcgggttaaccgttttcccggttcccgtttacccgtttaccgggtttaaggttttaccgggggtttcggggttttacgggggttttaccggggtttccgggttaccggggggtaccggggtaaacgggttaacccgtaacgggttaccccgggttccgttaaccccgggttcccgttaaacgggtcccggtaaacccggtcccgttaacgggtcccccgtcccccggttccccggtaggttacccccgttacccgggtttaccttccccggttacccccccggtccgttccccggtaaacgttccccgttaaggttacccggacggttacggggaccggggtcggtccggtaacccggg

SEQ ID NO: 101101 - DNA, 849 bp, Homo sapiens
  misc_feature: GYAE6OF01C6W1A.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctggtggtgactcaggacgccctcactgacgtgtcgtaccccgagggacggggacacgtcactctcacctgtcggctccagcacgtggacgctgtccaaccgtaagtcggtacctactttaacctccccgttaacgttacgggttacccaaacgacggaaacgtcctacggaccaaccggacccccgaagggtaacctaacgtagtaactttagtagtaactaaccaaaaacaaaccaaaacctaccgtcccgtaccggaacccccgtcggtacccgttcgtccgtaccgggtccttcccggttcggggttaccggggaacgaaagtcctcggtacccttacggtacccgggttttacgggccggtacgccgtacggtaccgtggggaacgtacggtaggacgggtcttagggtacgtttaactttacgggtcgttcgttcggtccctttccgttacctttaagtcggggtttcgggttcggggtttcgggttacggggtccgggtacggggtaaccgggaaccttaacgggcgttccgggtacccgttacgggtaaccggtcgaacccggtccggacgggtaccccgttcccggtacccccgttcggtacctacccccggttcgttaccccggtccccctaaccccgttcccgtaccggtacccgttaacgggtaacgttacccggtagggaccgggttccgggaacgtcccggggg

SEQ ID NO: 101102 - DNA, 949 bp, Homo sapiens
  misc_feature: GYAE6OF01BTJYP.15.5.A05.1.454.CMB.1.raw
tcagtctacgtagccacgaccggtgctcgatttagatagatagacaggggtcccttccaatatcagcaccatggcctggactcctctctttctgttcctcctcaccttgctgcccagggtccaacttcccaggctgtggtgactcgaggacgccctcactgactgtcgtcccaggaggacagtcactctcacctgtgctcagcacgtggagtctcgtaccaacctaagtcggtactaatttaccttaccccttaacgttccgggttacccaaaacgacggtaaccggtcccggtacggaccccgaaaccgaccccccgaaggtacctaaccgttagtaaacttttacgtaacgtaaactaaacctaaaaccgaaaacctaaaacctaacccgttcccgtacccggtaacccccttcggtacccccggttacctaccgtaccggtacccgtttccccggttacgggttaccggggggtaactaaaccggtcccgttacccggtacccccgttaccggttaacccccgggtttaccggggtccggtaccccggtaacccgtaccggttcccggttaacgggtaaacgggttacgtacgggtaaacgggtaccgtttagggtaaacggttttacgtttaccgtttacggttaacgtttcccgtacccgtttaaccggtttacccgtaagtttacggggtttacgggtttcgggttttaaccgggggtttcggggtttaccgggacccggggtaacgggtaccccggtaacgggttaacccggtccgggttaaccccgttacggttacgggtacccgtacggtaccccgtaacgtcccgtaccccggtcccggtccgttaccgtacgttcccgtacccgttccccgtacccttccggtacccgtaccgttaacggtaccgtaccgggtacgacgggggtccgtcgtaacgggg

SEQ ID NO: 101103 - DNA, 752 bp, Homo sapiens
  misc_feature: GYAE6OF01B17LJ.15.5.A05.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
tcagtctacgtagccacgaccggtgctcgatttagatagatagacaggggtcccttccaatatcagcaccatggcctggactcctctctttctgttcctcctcacttgcctgcccagggtccaattcccaggctggtggtgactcaggcgccctcacgtcgactcggtacgcccgagggaggacagtcactctccactgtcgctccagcncgtggacnctgcaacaagttgactacttctacctagttcggtaccaatacgaacgtccgacgacccaaccgcccctaggacacgttagtactttagngaaacctaanaaaccaaactaacaccctccgtaacccggccccttcggcccgttacgtaccgacggtccccgtaccgggttccgggagggtaaccaacggtcccgttaccgtccccgttaacggtcccggtttcgggccaccggtccggtaaccgtcggacggtaagggtgttaacggcgtaccgtggttaacgttgttccgtggtttacgcttccctcgttaccgtttaggttaccggtttggggtttacggtttcgggggttacggttaccggggacgggtacccgggtaacgacgggtcggttaaccgtacccggttacggtaaccgggttccgaaccggaccgaaccggtccggcccgttcccgtaccggtctacccgttccgtcccggtccctaccctcggtactaccggtacgtggacgttcggcgggcgttcgacggg

SEQ ID NO: 101104 - DNA, 735 bp, Homo sapiens
  misc_feature: GYAE6OF01ALNPB.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtcccagggaggacagtcactctcacctgtcggctccagcacgtggagctgtaccaacctaatggtactattactccctagtcggttaccaacgagaacgccgtacggacccaaccgcccccgaaggacctactgtaatttatagtaactaaaccaaaacaaaacctaaaacctaccttaccgtaccggtaccccgtacggtccccggtttacctaccgtaccggtcccttaccccggttccggggttacggggacctaaaacggtccgtaccgtccccgttaccggttaccccggtttcgggtccgccggaccgtacgtcccgtagggacggtagtcggacggtcgtagtaacgttacttacgtcgtacgttcgtcttccgttacgtagttaggttgggttcggtttgggtcggttcgggacgggtacggacgtacgtacgtaccggtaccgtaccggtacgtaccgacgtaccggtacgtccgtcccgcccgttcgtcccgtacctccggttcccgtccccgtcccgtcctccgtacctacgtacgtacgtggacgggtccgcgtacgg

SEQ ID NO: 101105 - DNA, 850 bp, Homo sapiens
  misc_feature: GYAE6OF01AHWON.15.5.A05.1.454.CMB.1.raw
tcagtctacgtagccacgaccggtgctcgatttagatagatagacagggtcccttccaatatcagcaccatggcctggactcctctctttctgttcctcctcacttgctgcccaggtccaattcccaggctgtggtgactcaggagccctcactgactgtcgtccccaggaggacagtcactctcacctgtcggctccagcacgtggagctcgtaccacctaagtggtactattactccctacgttcggttaccaacgagtaacgccgtcggaccctaaccgcccccgaaggacctaccgttagttaagttttactacgtaactaaaccaaaaaccaaaccaaaacctaccctacccgtaccggtaacccccttccgggtaccccgtttctaccgtacggtccccttccccggttcgggttacggggtaaccaaacggtccgtacccggtccccttacggtacccttaggtttccggggcgttccgaccgaacggtccgtaggtaacggaggttaccgggtacggtacgttaaggtaacgtttaacgttttaccgggtgttacccgtttcgtaccctttaccgtttaccggtttaaaggttacggggtttcgggtttttacgggtttcgggggttaccgggtttaccggggaaccggggttaaccgggaaccgtaaggtcccgtaccgggttaaccgtccggttaacgaccgtcccgaaccgggtcgtccccgttacccgccccggttaacgtccgtacccgttcccggttcccttacccccgttcccgttacccgtccgttacgttaaccggtaccggaacgttccgggtaaccgggtcgggtaaccgg

SEQ ID NO: 101106 - DNA, 879 bp, Homo sapiens
  misc_feature: GYAE6OF01B72OD.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctggtggtgacctcaggacgcccctcactgactcggtcgtccccgagggagggactacgtcactctcaccgtgtacggcctaccgagtccacgtgggtacgctcgtaccaaccgtagtcggtctaacttactccctacgttacggttaccaacgaacgaacgtccgtcggaccccgaaccggcccccgaaggtaaccctatagttattttagtagaaacctaaaaacaaaaccctaaaacgaacctacccgttacccggacccgtaaccccgtccggttccccggtctaccgtacccgtccctccggtttccggggtaacggacgtaaccgtccgtacccgtaccccgtacgtaccgtttaccggggttcggcggtcccgacggtacggccgtgggtaggtacgtaggtcggtacgttaacggtacttacgttacgttccggttcttaccgttaccttaccggtttaccgttaggttcgggtttccgggtttacggggttacgggttccgggggttaccggggtacgggtaaccgggtaccggtaaacggtcccgttaaccggttcccggtaccggttacggccggtaacccgtaccggaccggttacccgtccccgggtaccccgttcccggtaacccttcccgttacccggttcccccgttaccccccgtacccgtttcccggtaaccgttcccggttaacggttaacccggttcggtaccggggccggttaccggggtacccggg

SEQ ID NO: 101107 - DNA, 703 bp, Homo sapiens
  misc_feature: GYAE6OF01DCKHX.15.5.A05.1.454.CMB.1.raw
  modified_base (547)..(547): a, c, t, g, unknown or other
  misc_feature (547)..(547): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcgaggacgccctcactgactgtcgtcccgaggaggacagtcactctcacctgtcgctcagcacgtggagtcgtcgtaccaactaagtgtactacttacctccttacgtacgtaccaacgtacgaacgccgacgaccaaccgacccgaacgactactagttacttaatagaaactaaacaaaacaaacaaacctaccgtacccgtaccgtaccccgttcggtcccgttcacgtaccgtcccgtccggtcggtacgggaacgaacgtccgtccgtaccgtcgttcccgggttcggcgacgcgacgtcgagaggagtagacgtcgtagtagttacgtctcgttactcgtaccgttcttaacggtgttcggttgggttcggggttcggtggtaccgggagaccggtaacncggttaccgtcgtaaccgtcgtacgtacggacccgacgtaccggtcccgttccccgacccgggttctaccccggtttcgtccccgttaaccccggtcccttacccgacgttcccgaaccgtttaaggcctaacggcgggaccgggtgtaccggtgg

SEQ ID NO: 101108 - DNA, 723 bp, Homo sapiens
  misc_feature: GYAE6OF01CVVZV.15.5.A05.1.454.CMB.1.raw
  modified_base (323)..(323): a, c, t, g, unknown or other
  misc_feature (323)..(323): n is a, c, g, or t
  modified_base (676)..(676): a, c, t, g, unknown or other
  misc_feature (676)..(676): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactgtcgcccgaggacggacagtcactctcaccgtgtcggcctccagcacgtggagtctgtccactaagttcggtactaattactcccttaacgttcggttaccaaacgagaacgtccgtacggacccaaccgaccccgtaaggacctaaccgtgtaacgttttanacctaaactaaccaaaaacctaaaccgaaacctacctaccgtaccggtacccctcggtacccgtttcaccgtaacgtcctcccgtgggtacgggaacacgtctcggtaccgtcgttacccgttggcgcgtacctacggcgttaggacggttagcggtaggtctaaggcgtttacgtacggtctcgttcgaccgttcgttacctttaaggtcggtttcggttcgggtttcgggtgggtaccggtaggggaaccgttaacggacgtaccgtcgttaaccggtccgttacgccgacggacccgtacggtcccgtacccggttccgcgtaaccgtccgttcccgtcccggttccccncccggtcttacccgcttaacgtccgacgttaggccgtcggcgggacg

SEQ ID NO: 101109 - DNA, 706 bp, Homo sapiens
  misc_feature: GYAE6OF01EW5JB.15.5.A05.1.454.CMB.1.raw
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccaggaggacngtcactctcactgtgctccagccactgganctgtcaccaatggtcattacnccctatggttaccaacagaacgcctggccaacgccccaggtacactgacttatgataacaaacaacaaacactactacggaccctgacccgttctcgacgtctcctcggttcggggacaaacgctcgcccgtcgtacccgttcgggtacgcgacgtcgcctaggacgaacgtggaaggcttaggagttaactttaccgtgtccgtttggccttccgttaccttacgtaacggttggtttacggttcggggttcggttacgggcgggtacgggtaacccaggcgttaccggtacccggttacccgtaggtacccggtaacggaccccgtaaggtcccggttacccggtcccccgttacgggtaccctacccgttcccgtttaccccgtttaccccccgtaaccccgttcccgttacccgtaacgtttacccggttaaacgtacccgtaccgggtaacgggtcccgggtccggtaacgggg

SEQ ID NO: 101110 - DNA, 936 bp, Homo sapiens
  misc_feature: GYAE6OF01EO86T.15.5.A05.1.454.CMB.1.raw
  modified_base (138)..(138): a, c, t, g, unknown or other
  misc_feature (138)..(138): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtnactcgaggagccctcactgactgtcgtcccgaggaggacagtcactctcactgtcgctccacgcactggacgtctcgacacctaagtcgtctacttactccctacgttcggttaccaaacagaacgtcctacggaccaaccggcccccgaggtaccctaacttacggtactttagtacgtaaactaaaccgaaaaccaaaaccgtaaaccgtacccgttacccgtacccgggtaaccccgtccgggtacccccggtttcctaccggtaaccggttcccgttcccggttaccgggttaccggggtaaccgtaaacggtcccgttacccgtacccggttacccggttacccggtttaccggggacggccggtaccgaccggtacccgttaggggacggtaacggtacgggtacggttcggtaacggttacgtttaccgttacgtaccggttacgtttacccgtccctttaaccgtaccttaacggggtttaggtttccgggggttttagggttttccggggttaccggggtttccgggaaccgggggtaacgggttaacccgtaacgggtcccggtttaaccgggttaaccccggtttaccggtaaccgtttacccggaaccgtaccccggttacggggttacccaccccgtttacccccggtaacgttcccgtaaccccgttttccggttaccccccggttcccgttaacccctcccggtttaaccccgggtaccggtttaaacccggtacggtttacccgggacgggtaaccgggggttccggtaaccgggtcccggg

SEQ ID NO: 101111 - DNA, 748 bp, Homo sapiens
  misc_feature: GYAE6OF01DUCKV.15.5.A05.1.454.CMB.1.raw
  modified_base (153)..(153): a, c, t, g, unknown or other
  misc_feature (153)..(153): n is a, c, g, or t
  modified_base (284)..(284): a, c, t, g, unknown or other
  misc_feature (284)..(284): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctnactgactgtcgtcccagggaggacagtcactctcacctgtgctcagcactggagctgtccacaatgtcattactccctatcggtccaacagaacgcctcggaccacgaccccaggacctactcgtattacngaactaacaaacaaacaaactactaccgtcggaccctcgtcccgttctcgacgtcctcccgtcggttacggggacaacgtcgtcgcccgtcgtacccgttcggtcgtcgcgcggaccgtggacggtagtcggacggtacgtagggtaatttacgttaccgtgttccgttcggtacctttcctacgttaacgttacgggtttggggtttacgggtttccggggttcgggttccggggtaaccggggtacgggtaacccgtacggtaccggttaccgtaacccggttacccggtacgggttccgaccgggtacccgtaaccgggtcccgttcccgggtacccccgttccggtaacccgttcccgttcccggttaccccttaccccccgttccccttcccgttcccggtacccttaccgggtacgtaacccggtacggtaacgggtcccggggtacgtaacccgggg

SEQ ID NO: 101112 - DNA, 721 bp, Homo sapiens
  misc_feature: GYAE6OF01EU4IC.15.5.A05.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (622)..(622): a, c, t, g, unknown or other
  misc_feature (622)..(622): n is a, c, g, or t
  modified_base (706)..(706): a, c, t, g, unknown or other
  misc_feature (706)..(706): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctnactgactgtgtccccaggaggacagtcactctcacctgtggctccagcactgganctcgtcaccaatggtcattanccctatggttccaacngaacgcctggccaagcccccaaggacactgaacttatcgatacaaaacaacgaaacactcccgttacggaccccctagccccggttactccgaacgggtcctcccgtcggttcggggggcaaaacgccgtcggtccccgttggaacccccggttttcggggtcgtccggtaccgaacggttccccgtagggtaccggtaaagtcggaacgggtcccgttaaggtaaggtttaacgtttaacctgggtaactttcgggcctttaaccgtcccgtttaagttaacggttggggtttccgtttaaccgggggttggttttccgggccgggagggtaaaccccgtagggaactttcggacccggttacccgtagggttaccncgacccgttaacgggcctaacggcccccgttcggtccacgttccgtcgttcccgacccttccgcgtccctacgtcgaccttagnggccggtcgtccggg

SEQ ID NO: 101113 - DNA, 726 bp, Homo sapiens
  misc_feature: GYAE6OF01A7ELE.15.5.A05.1.454.CMB.1.raw
  modified_base (208)..(208): a, c, t, g, unknown or other
  misc_feature (208)..(208): n is a, c, g, or t
  modified_base (695)..(695): a, c, t, g, unknown or other
  misc_feature (695)..(695): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtcgctccagcactgganctgtcaaccaatggtacattactccctactcggttaccaacaagaacgcccgttggacccaaaccgcccccgaaggaaccacgtagtactttaagtacgaactaacgaaaaacaaaaccaaaaccgaccttaccgtaccggaccccctacggtcccgtttactacgaaccggtcctcccgtcggttacgggacaaacgctccgcctcgtacccgttcggtagccgacgtcgaccgtggacgtacgtagaggtcgtaggtaagttacttaacgtgttacctgaccttccgttactaacggtggttacggttggtttacggggtacgttcgggaaccgggtaggtaaccctaacggtcgtaccggtaacccgttccgtaacgggacctaaccgacccgaacgggtccttaccccggccctttacggtcctaaccggttcccgttaccgttccccgaacccccttgtacccgtattaaccccgggttaancccggtaaggacgggtcggtccgtaaacggg

SEQ ID NO: 101114 - DNA, 837 bp, Homo sapiens
  misc_feature: GYAE6OF01AJASJ.15.5.A05.1.454.CMB.1.raw
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcgaggagccctcactgacttgtcgtccccgagggacgggacagtcactctcacctggtcgcctccaggccacgtggacgtcctacgtccaaccgtaagtcggtactacgttcctacccctacgtcggtaccaacgacggtaacgccgtcggacctaacccggacccctaaggacctacgttacgttaacttttagaccggaataaaccccaaaaccgaaaacctaaacccggtaccctttcccgtaaccgggtacccccgttcggtccccgttaccgtccggaccggttcccgtcccggttacgggtcggggaacaacgtccgtcccgtccgtacgtaccgtacggttcggcgtaccncgtacccggtcgtacggacggtntacgggagttacccgtagtacgttacgttcgttcgtacgttccgtccgttacctcgtttaacgtcggggtttccgggttacgggtttcgggtaccggggttcggggtaacccgggtacggtaaccccgtacggtacccggttacccgggtacccggttaaccgtttacgggaaccggtacccggtacccgggtaacgtcccggtaccccgtcccggttccgtaccgtccgttcccgttcccgttaccccggtacccttcccggtaccgttaccggttaccgtaccgacgggcggtaccggtcccgggtaccggg

SEQ ID NO: 101115 - DNA, 724 bp, Homo sapiens
  misc_feature: GYAE6OF01BGZ3G.15.5.A05.1.454.CMB.1.raw
  modified_base (137)..(137): a, c, t, g, unknown or other
  misc_feature (137)..(137): n is a, c, g, or t
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (432)..(432): a, c, t, g, unknown or other
  misc_feature (432)..(432): n is a, c, g, or t
  modified_base (486)..(486): a, c, t, g, unknown or other
  misc_feature (486)..(486): n is a, c, g, or t
tcagtctacgtagccacgaccggtgctcgatttagatagatagacagggtcccttccaatatcagcacatggcctggactcctctctttctgttcctcctcacttgctagcccaggtccaattcccaggctgtggtnactcaggcgccctcactgactgtcgtccccgagggaggacagtcactctcacctggtgctcagcactgganctcgtacacctaagtggtcatttactcccgtactcggttaccaatagaacgccgtacggaccaaccggacccccgaaggtacctacgtgttaatttanacgtaactaacaaaacaaaccaaacctactacccgtaccgaccccgttacggtcccgtttanccgacgtcccttaccggttcgggttacggggacaacgtcgtccgtccgtcggtaccgttcgggnccgaccgtacgtcgtaggagtacgtgacgggtactaggtaacgttaacttcgtntacgtttcgccgttcttacgtagttcggttgggttacgggttccgggttggttccggggaacggtaccgggtaactaccgggcgttaaaccggtccgttacgggaacttccgaaccggttcccggaacgttcccgtaccgtcccccggttggtaccaccgtttcccgtccttccccgtaccctccggttacctaccggttaacgtaccgacgttacgggaccggtcgggtgaacccgg

SEQ ID NO: 101116 - DNA, 683 bp, Homo sapiens
  misc_feature: GYAE6OF01BVTUT.15.5.A05.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctnactgactgtcgtcccaggagggacagtcactctcactgtggctcagcactgganctgtccacaatggtcattactcctatggttaccaactagaacncctgacccaacgccccgagaccactagtatttangtaataacaaacaaacaaactaccgtacctaccggaccctcggtcccgttacnccgagtccgtccgtcggtggactaagcctcgtcctgtacccgttggngccacgcgtccgtggaacggtgaggacgcgttagagttcttacgtntacgttntccgttacgtccgtaggttacgtggggtttcggtttacggggtcggttcgggacgggacgtaccggtagtccgttacggtaccggttacccgtaaggggtaccgaccggtacccgaacgggttcccctaccggttacccccgttcggttccctacccggttcccgttacccgtttccccaaccccggttccgtacccgttaaccgtccggtaacgaccggtaggacgggtccgggtcgtaaccggg

SEQ ID NO: 101117 - DNA, 734 bp, Homo sapiens
  misc_feature: GYAE6OF01ENAWT.15.5.A05.1.454.CMB.1.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtcggctccagcacgtggagctcgtcaacctaatggtctattactccctacgtcggttaccaacaagaacgccgtacggaccaacgcccccgaggaccactgtatttanagaataacaaacaacaaacactaccgtcggaccctcgcccgttacncgacgcctccgtcggtcgggacaacgctacgccctcggtacccgtttcgggngtccgacgtcgcgtaggacggtagtacggaggtcgtaggtattacgttacgtgtcttacgcctttacgtccttaagtggttgggttcggtttacggggttcggttcgggtacggggaacggtaaccgaacgggtctaccggtacccgttacggtaccgggtaccgtaaccggtacccgaaccgggtcccttaccccgggcccccgttacgggttacccctaccgttttacccgttccccggttacccccttacccccgtcccggttacccgaaccggtttaaccggtaacggtacccggtaggggaacccgggtccggggtcgtaacccggggg

SEQ ID NO: 101118 - DNA, 672 bp, Homo sapiens
  misc_feature: GYAE6OF01A10CZ.15.5.A05.1.454.CMB.1.raw
  modified_base (300)..(300): a, c, t, g, unknown or other
  misc_feature (300)..(300): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggcctccagcacgtggagctgtccaaccaagtggtctagtttactccctacgtcggttaccaacagaacgccgtcggaccaacgccccgaggacactagtattacngtataacaaacaacaacactccgacgacccgtcgtcccgtctacgacgtcctccgtcggtacgggacaacgtcgtcgccgtcgtacccgttcggtcgccgacacggtcgtaggaggtagtcggacggtcgtacgtagttacgttacgtcgtacgttcgtacttccgttacttagttgggttacggttcgggtttcgggtcgggttacgggcgggtaacggaccgtaagtcgtacggtaaccggtcgtaacggtccgtacgaccgtacgccgtcccgccccgttcgtacccgtaccgttccgttcccgttccccgtcccgttcccgtaccgtaccgttacgtcggacgttgggaccggtcgggtcggtacggg

SEQ ID NO: 101119 - DNA, 763 bp, Homo sapiens
  misc_feature: GYAE6OF01B2CAA.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactgtgtccccaggacgggacagtcactctcacctgtgctccagcacgtggagctgtcaccaatcggtctattactccctacgttcgttaccaacgacgaacgcctcggacccaacgcccccaggacctacgtgtaactttatcgaataaacaaacaaacaaacctacgtaccgtacggacccccgtcggtacccggttctccgacgtcctacccgttcggtaggggactaacgccgtcgtcccgtacggtacccgttcgggtcgcgcgacgccgtagaggactaggaggtctaggacgtttacgttacgtgtacgttcgtccttacgtaccgttagttacggttgggttcggtttacgggtgggtttccggacgggtcggtaacccgaggtcctaccggtaaccggttcccgtaggtacccgaccgggtacccgtaacgggtccccgttacccggtcccccgttacgggttacccctacccgtttcccggtttccccgttcccccccggttcccccgttcccgggttacccccttaaccggggttaccgtaaccggtaacccggttcggggaaacccggtcccggggggttaccgtaaccggggg

SEQ ID NO: 101120 - DNA, 780 bp, Homo sapiens
  misc_feature: GYAE6OF01BZZ5Y.15.5.A05.1.454.CMB.1.raw
  modified_base (333)..(333): a, c, t, g, unknown or other
  misc_feature (333)..(333): n is a, c, g, or t
tcagtctacgtagccacgaccggtgctcgatttagatagatagacaggggtcccttcaatatcagcaccatggcctggactcctctctttctgttcctcctcacttgctgcccaggtccaattccaggctgtggtgactcaggacgccctcactgactgtcgtcccaggaggacagtcactctcacctgtcggctccagcacgtggacgctgtacaaccgaagttcggtactaatttactacccgttacgttacggttacccaaacgaacggaacgccgttacgggaacccaaccggacccccgaaggtaacctacgtagtaacgttttaacngtaaactaaacaaaaccaaaaacaaacctacgtacccgtaccgaaccccttcggtcccggtttacaccgtacggtaccttccccggtcgggttaacgggggacctaaagtccgtaccgtccccgttacggtacccggtttcggcggccgactacgaccgtaggacggtagtaccggagtacgtaggtaagtaacgtttcgtgttccgtttgaccctttaccgtacgttaggttaacgggttcgggttacgggtttacggggttcggttaccggggcgggtaaaccgggtaaccgaacgggttccgtaaccgggtacccgttaggtaccgtacgacccgggactaaccgggtcgtacccgttccccgtacgtccgtacttccggtcccgttaccccctacctccgtaccgtactaccggtcgacttacgggcggaccggtgtaacggg

SEQ ID NO: 101121 - DNA, 558 bp, Homo sapiens
  misc_feature: GYAE6OF01CKNND.15.5.A05.1.454.CMB.1.raw
  modified_base (153)..(153): a, c, t, g, unknown or other
  misc_feature (153)..(153): n is a, c, g, or t
  modified_base (402)..(402): a, c, t, g, unknown or other
  misc_feature (402)..(402): n is a, c, g, or t
  modified_base (473)..(473): a, c, t, g, unknown or other
  misc_feature (473)..(473): n is a, c, g, or t
  modified_base (551)..(551): a, c, t, g, unknown or other
  misc_feature (551)..(551): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactggagctgtcaccaatggtcattatccctaatggttccaacagaagcctggccaagccccaggacactgatttatgatacaaaacaacaaacactcctacggacccctacgcccggttactcagctccctcgttggggcctaaagctcgcctcgtaccctttcggtgcgcagcctgagagtgagctgagtattactgntgctctcctatacgtgtgttcggtgttcgtcggacggacaagcgtagaccgtccgaggtcagccgaacgcnccggtccccctcggtcctacgtccgttacgttccccctacccgtcccttcgcgttaccgttacgactggacgccgggntaccggg

SEQ ID NO: 101122 - DNA, 806 bp, Homo sapiens
  misc_feature: GYAE6OF01DEXVL.15.5.A05.1.454.CMB.1.raw
  modified_base (547)..(547): a, c, t, g, unknown or other
  misc_feature (547)..(547): n is a, c, g, or t
  modified_base (745)..(745): a, c, t, g, unknown or other
  misc_feature (745)..(745): n is a, c, g, or t
tcagtctacgtagccacgaccggtgctcgatttagatagatagacagggggtcccttccaatatcagcaccatggcctggactcctctctttctgttcctcctcacttgctcgcccgagggtcctaacttcccaggctggtggtgactcgaggacgccctcactgactgtcgtcccgagggaggacagtcactctacaccgtgtcggcctaccgagcacgtggacgcgtcgtaccaccaattcggttctaacttctacctacgttcggttaacccaaacgacggaacgtccgtacggaccgaacccggacccgaacggaactacgttagtaattttagaacgtaataaacctaaaaaccgaaaccaaacctaccgtacccgtacccggtaccccgtaccggtaccccggttccgttaccgaccgggttcccttcccgggttacggtacggggaacctaacgggtaccttcccggttaccccgttacgggtttcccgggtttacgggcgaccgtaccgaaccgttcgacgggtagtacggttaacggnggtacgtaaggtgtttacttacggtcgtcgttcgttacttacgttcgttagggttacggttgggtttacgggttcgggtgttacggggacggtacggtacgtacgcggtacccgtaccggttgaccgggtcaacggcccggtacggtccctccggttacccgccttccgtaccggtttaccctccggtttaccccccncggttcccgtacccggtaacgtcggttacccacgggttacggcggttccggaacgtccggg

SEQ ID NO: 101123 - DNA, 887 bp, Homo sapiens
  misc_feature: GYAE6OF01ART64.15.5.A05.1.454.CMB.1.raw
  modified_base (86)..(86): a, c, t, g, unknown or other
  misc_feature (86)..(86): n is a, c, g, or t
  modified_base (179)..(179): a, c, t, g, unknown or other
  misc_feature (179)..(179): n is a, c, g, or t
  modified_base (879)..(879): a, c, t, g, unknown or other
  misc_feature (879)..(879): n is a, c, g, or t
tcagtctacgtagccacgaccggtgctcgatttagatagatagacaggggtcccttccaatatcagcaccatggcctggactcctntctttctgttcctcctcacttgctgcccagggtccaattcccaggctgtggtgactcaggacgccctcactgactgtcgtcccgaggaggacngtcactctcacctgtggcctaccagcacgtggacgtcgtactaccaccaagttcggtactacgtttaactccccttacgttcggttaacctaaacgtaggtaaccgccgtacggacccgaaaccgtccccgaaggaaccctacttagttaagtttaattacgaacttaaaccaaaaccaaaccgtaaaccgtaccttacccgtaccggtaacccccgttaccggttaccccgggtttacctccgggtaccgggtccccttaccccgggtttacggggttacgggggaaccgtaaaccggtccggttacccggttccccggttaccgggtttaccccggtttaccggggttaccggcccggtaccgtaacggtacccgtacgggaacggggttacggttacgggaacgggttacgttacgggttaacgtttacgtttacgtacggttcgttccgttcttaccgttacggttaagtttcgggttacgggttcggggtttacccggggttggtacccggggtaacggaccgggaactaccgggtacccgttaccgtaaccccggttaggttaccggaccgtacccgaacgtacggtcccgtcccgtaccccgttcgtacccgtacccgtttccgtcccggcccccttcggtcccgtacccggttacgtccgtaaccggttacgggaccggtacgggtcccggngtaccggg

SEQ ID NO: 101124 - DNA, 853 bp, Homo sapiens
  misc_feature: GYAE6OF01CPPE3.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtcccaggaggacagtcactctcacctgtcggctccgagcacgtggagtctgtaccacctaagtcggtactactttactccccgttaacgttcggttaccaacgtaacggaacgcccgtacggacccaaaccggcccccgaagggaacctacgttacggttaacttttaacgtacgtaacttaaacccaaaaaccgtaaaaccgtaaaaccctacccgttacccgttacccgggtaacccccccgttccgggtacccccgggttttacctaccgtaaccgggttccccttcccccgggttacggggtttaccggggggaaaccctaaacgggtcccgttaaccggtcccccgtttacgggttaccccggtttcggggtccggacccggtccgtacggtacccgtagggacggtacggtacgggtacggtcgttaggtaacgttacttacggtcgtcttcgtccttacgtacctagttacggttgggttacgggtttcgggtcggtacgggacggtaacgggtaccaagtcgtaccggtaccgtaccgttacggtcgaaccggtaccgtacggtcccgtcccggtcccccgttacggtcctacccggttccgtccccggttcccctacccgtttccgaccgttacccgtaacgtccgtacggtgggtacccgggtcgggttcggtacggg

SEQ ID NO: 101125 - DNA, 519 bp, Homo sapiens
  misc_feature: GYAE6OF02IDA1M.15.5.A05.1.454.CMB.1.raw
  modified_base (363)..(363): a, c, t, g, unknown or other
  misc_feature (363)..(363): n is a, c, g, or t
  modified_base (515)..(515): a, c, t, g, unknown or other
  misc_feature (515)..(515): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgttgggggcaaagctgccctgacccttcgggtncgcagcctgaggatgaggctgagtatactgcttgctctcctatagtggtgttcgggtgttcggcggagggaccaagctgaccgtctaggtcagcccaaggctgcccctggtcactctgttcccacctcctcgctacgtagacctgagcgggntcgg

SEQ ID NO: 101126 - DNA, 525 bp, Homo sapiens
  misc_feature: GYAE6OF02INU9I.15.5.A05.1.454.CMB.1.raw
  modified_base (521)..(521): a, c, t, g, unknown or other
  misc_feature (521)..(521): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaacagaagcctggccaagcccccaggacactgatttatgatacaaacaacaaaacactcctggacccctgccccggttctcaggctccctcgttgggggcaaagctgccctgacccttcgggtgcgcagcctgaggatgaggctgagtattactgcttgctctcctatagtgtgttcgggtgttcggcggagggaccaagctgaccgtcctagtcagccaaggctcgcccctcggtcactctcgttcccgcctcctcgctacgtagactgacgcgggntcgg

SEQ ID NO: 101127 - DNA, 522 bp, Homo sapiens
  misc_feature: GYAE6OF02G8O96.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtctaggtcagcccacggctcgcccctcggtcactcgtcgtcccgcctcctcgctacgtactgagcggctggcg

SEQ ID NO: 101128 - DNA, 521 bp, Homo sapiens
  misc_feature: GYAE6OF02GAW0I.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccatttcgggtgcgcagcctgaggatgagctgagtatactgcttgctctcctatagtggttgttcgggtgttcggcggtagggaccaagctgaccgtctaggtcagcccaaggctcgcccctggtcactctcgttcccgccctcctcgctacgtacgactgagcggtcg

SEQ ID NO: 101129 - DNA, 528 bp, Homo sapiens
  misc_feature: GYAE6OF02HK8PQ.15.5.A05.1.454.CMB.1.raw
  modified_base (396)..(396): a, c, t, g, unknown or other
  misc_feature (396)..(396): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaaacaaacactcctggacccctgcccggttctcagctccctcgttgggggcaaagctcgccctgaccctttcgggtgcgcagcctgaggatgaggctgagtattacngtctgctctctatagtggtgttcggtgttcggcggaggacagctgaccgtcgtagtcagccaaggctcgccccncggtcnctcgtcgttccccaccctcctccgtcgtacgtacgaccgtgacgcggctcgg

SEQ ID NO: 101130 - DNA, 523 bp, Homo sapiens
  misc_feature: GYAE6OF02GMMD2.15.5.A05.1.454.CMB.1.raw
  modified_base (364)..(364): a, c, t, g, unknown or other
  misc_feature (364)..(364): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagcctggccaagcccccaggacactgatttatgatacaaacaacaaacactcctggacccctgcccggttctcaggctcctcgttgggggcaaagctgccctgaccatttcgggngcgcagcctgaggatgaggctgagtattactgcttgctctcctatagtggttgttcgggtgttcggcggagggaccaagctgaccgtcctaggtcagcccaaggctgcccctggtcacgtctcgttcccaccctcctcgctacgtagctcgagcggtcg

SEQ ID NO: 101131 - DNA, 523 bp, Homo sapiens
  misc_feature: GYAE6OF02IC8RP.15.5.A05.1.454.CMB.1.raw
  modified_base (358)..(358): a, c, t, g, unknown or other
  misc_feature (358)..(358): n is a, c, g, or t
  modified_base (473)..(473): a, c, t, g, unknown or other
  misc_feature (473)..(473): n is a, c, g, or t
  modified_base (518)..(518): a, c, t, g, unknown or other
  misc_feature (518)..(518): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatggttccaacagaagcctggccaagcccccaggacactgatttatgatacaaacaacaaacactcctggacccctgcccgttctctgctccctcgttggggcaagctgccctgcccttggtcncgcagcctgagatgaggctgagtatactgcttgctctctatagtggtgttcgggtgttcgggcggagggacaagctcggaccgtcgtaggcacgacccaaggctcgcccctgtcnctcgtcgttcccacctcctcgctaccgtagactggacgtccgggntcggg

SEQ ID NO: 101132 - DNA, 528 bp, Homo sapiens
  misc_feature: GYAE6OF02G7T4R.15.5.A05.1.454.CMB.1.raw
  modified_base (365)..(365): a, c, t, g, unknown or other
  misc_feature (365)..(365): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctggacccctgcccggttctcaggctccctcgttgggggcaaagctgccctgaccctttcgggngcgcagcctgaggatgaggctgagtattactgcttgctctctatagtggtgttcgggtgttcgggcggagggaccaaggctgaccatccgtagtcacgccaaggctcgcccctggtcactctcgttcccgccctcctcgcctacgtacgactggacgcggtcg

SEQ ID NO: 101133 - DNA, 536 bp, Homo sapiens
  misc_feature: GYAE6OF02I0FKY.15.5.A05.1.454.CMB.1.raw
  modified_base (359)..(359): a, c, t, g, unknown or other
  misc_feature (359)..(359): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctggacccctgcccgttctcaggctcctcgttggggcaaagctgccctgaccctttcggngcgcagcctgaggatgaggctagagtattactgtcttgctctcctatagtggtgttcgggtgttcggcggaggaccaagctgaccgtcgtaggtcacgcccgaaggcctcgcccctcggtccacgttcgtcgttccccgcctcccgtcgctacgtacgacgtggacggccggctcgg

SEQ ID NO: 101134 - DNA, 538 bp, Homo sapiens
  misc_feature: GYAE6OF02HYI01.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctggacccctgcccggttctcaggctcctcgttgggggcaaagctgccctgaccatttcgggtgcgcagcctgaggatgaggctgagtattactgtcttgcttctcctatagttggtgtttgggtgttcgggcggagggaccaagctgaccgtctaggtcagcccaaggctcgcccctggtccacgtcctcgttccccgccctcccgtcgccttacggtacgacgtcgacggcggtcgg

SEQ ID NO: 101135 - DNA, 529 bp, Homo sapiens
  misc_feature: GYAE6OF02IAL92.15.5.A05.1.454.CMB.1.raw
  modified_base (360)..(360): a, c, t, g, unknown or other
  misc_feature (360)..(360): n is a, c, g, or t
  modified_base (525)..(525): a, c, t, g, unknown or other
  misc_feature (525)..(525): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttatgatacaaacaacaaacactcctggacccctgcccgttctcaggctccctcgttggggcaaagctgccctgacccttgggtncgcagcctgaggatgaggctgagtattactgtcttgcttctcctatagtggtgttcgggtgttcgggcggtagggaccaaggctcggaccgtctaggtcacgccgaaggctcgcccctggtccactcgtcgttcccacctcctcgctacgtcgactgacgtcggntcgg

SEQ ID NO: 101136 - DNA, 528 bp, Homo sapiens
  misc_feature: GYAE6OF02HOHQJ.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctatggttccaacagaagcctggccaagcccccaggacactgatttatgatacaaacaacaaacactcctggacccctgccccggttctcaggctccctcgttgggggcaaagctgccctgaccctttcgggtgcgcagcctgaggatgaggctgagtattactgcttgctctcctatagtggtgttcgggtgtcggcggagggccaagctgaccgtctaggtcagccaaggctcgcccctggtcacgtctcgttccccgcctcctcgcctacgtagacctggacgcgggctcggg

SEQ ID NO: 101137 - DNA, 562 bp, Homo sapiens
  misc_feature: GYAE6OF02HNW9J.15.5.A05.1.454.CMB.1.raw
  modified_base (229)..(229): a, c, t, g, unknown or other
  misc_feature (229)..(229): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattanccctatggttccaacgagaagcctggccaagcccccaggacactgatttatgatacaaacaacaaacactccgtggacccctgcccggttctcgtacggctccctcgttcgggggcaaagctcgccctgtacccttgggtcgcgcagcctgacggatggaggctgagtattacgtgtcttgctcttcctagtagtggtggttcgggtgttcgggcggagggtaccagtcgtgaccgtcgtaagcacgccaaggctcgcccgtcggtaccacgttccgtcgttccctaccctccgtccgcgttaccggtacgtacgtcggacggccggtgtcgg

SEQ ID NO: 101138 - DNA, 578 bp, Homo sapiens
  misc_feature: GYAE6OF02HRZ7Y.15.5.A05.1.454.CMB.1.raw
  modified_base (281)..(281): a, c, t, g, unknown or other
  misc_feature (281)..(281): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangataacaaaacaaacaaacactcctacggacccctgcccggttctcacggctcccgtcggttcgggggacaaagctcgccctcgtacccgtttcgggcgcgcacgcctgaggtagtcgaggctgagtattacgtgtcttgctctctagtgtggttgttcgggtgttcggcggagggaccaaggctgaccgtccgtagtcacgccgaaggcctcgcccctggtcctaccgtccgtccgttccccacccgttcccgtccgtacgttaccgtacggaccttggacggtccgggtctcggg

SEQ ID NO: 101139 - DNA, 529 bp, Homo sapiens
  misc_feature: GYAE6OF02FPBL2.15.5.A05.1.454.CMB.1.raw
  modified_base (439)..(439): a, c, t, g, unknown or other
  misc_feature (439)..(439): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgcccggttctcaggctccctcgttggggcaagctcgccctgaccctttcgggtgcgcacgcctggaggagtggagggctggagttattactgcttgcttctcctatagtggtgttcgggtgttcgggnggaggacagctgaccgtcgtagtcacgccgagctcgcccctcgcactctcgtcccacctcctcgcctacgtcgacgtgacgcggtgtcgg

SEQ ID NO: 101140 - DNA, 530 bp, Homo sapiens
  misc_feature: GYAE6OF02F3D9W.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgattatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcgggcggagggaccaagctgaccgtcctaggtcagcccaaggctcgcccctcgtcactctcgttcccaccctcctcgctacgtacgacctgacgtcgggctcgg

SEQ ID NO: 101141 - DNA, 523 bp, Homo sapiens
  misc_feature: GYAE6OF02HQZUP.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcggtgttcggcggaggacaagctgaccgtcctagtcagcccaaggctcgcccctgtcactctcgttccccgcctcctcgctacgtacgacctgacggcggctcgg

SEQ ID NO: 101142 - DNA, 569 bp, Homo sapiens
  misc_feature: GYAE6OF02IM3XM.15.5.A05.1.454.CMB.1.raw
  modified_base (282)..(282): a, c, t, g, unknown or other
  misc_feature (282)..(282): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagccccccaggacactgatttangatacaaacaacaaacactcctggacccctgccccggttctcaggcctcccgtcgttgggggcaaagctgccctgtacccgtttcgggtgcgcacgcctgaggatggaggctgagtattactgcttgcttctcctatagtggtgttcgggtgttcgggcggtagggaccaaggctaggaccgttcgtaggtcacgcccaaggcctcgtccccgtcggtcctaccgtcctcgttaccccacccgttcccgtcgaccgttacgtacgtaccgtggacggcgggctcggg

SEQ ID NO: 101143 - DNA, 763 bp, Homo sapiens
  misc_feature: GYAE6OF02JYKAM.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaacgcctggccaacgcccccaggacactgatttatgataacaaacaacaaacactacctacggacccctgtcccggttctccgacggtcctacccgttcggttcgggggaccaaaggtcctacgtcccgtacgtacccgtttcgggtcgtcgcgtacgacccgtggaggtacgttggacgggtcgtaggtacgttaacgtttaaccgttggttccgtttcggtacctttccgtttacccgttaagttacgggttcgggtttagggtttacgggggtttacgggtttacggggacggggtaacggggtacccgtaaaggtccgttacgggtacccggttaccggtacggttaccgaacgtaccccggtaaggtcccgttacccggtcccccgttacggttcccgtaaccgtttcccgttcccggttcccccggtacccgtttcccgttccccggttaccgttaccgggttaaccggtaccgttaccggggaccgggtccgggtcccggtaccgggg

SEQ ID NO: 101144 - DNA, 516 bp, Homo sapiens
  misc_feature: GYAE6OF02FSWZK.15.5.A05.1.454.CMB.1.raw
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaanagaagcctggccaagcccccaggacactgatttatgatacaaacaacaaacactcctggacccctgcccggttcncaggctccctcgttgggggcaagctgccctgaccctttcggtgcgcagcctgaggatgaggctgagtatactgcttgctctctatgtggtgttggtgttcggcggagggaccagctgaccgtctaggtcagccaagctcgccccgtgtcactcgtcgttccccgcctcctcgcctacgtagctggngcggntcgg

SEQ ID NO: 101145 - DNA, 575 bp, Homo sapiens
  misc_feature: GYAE6OF02IX8AN.15.5.A05.1.454.CMB.1.raw
  modified_base (426)..(426): a, c, t, g, unknown or other
  misc_feature (426)..(426): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgcccgttctcacggctcccgtcgttgggggcaaagctcgccctgacccttggcgcgcagcctgacggatgaggctgagtatactgctgctctctatagtgtgttcggtgttcggngtagtcggaccaagtctcgaccgtcgtacggtcacgccgaacggccgtaccgtcccccgtcggtcctacgttccgttccgtttccccggtccccttcccgttccgtcccgttaaccggtaccgtaccgtcggacgggtccgggtaccgg

SEQ ID NO: 101146 - DNA, 638 bp, Homo sapiens
  misc_feature: GYAE6OF02G5463.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggttccaacagaagcctggccaagcccccaggacactgattatgatacaaaacaacaaacactcctacggacccctcgccccggttctcaggcctccctcggttgggggacaaagctcgccctgaccctttcgggtcgcgcgacgccgtggacggagtcgaggtctggagttatttacgtgtcttgcctctacctagtagtgggttcgttcgggttcggttcgggcgggtacgggaccgtaaggcctacgggtacccgttaccgtacggtcgacgtacccgaacgggccttccgcccccgtcggttcctaccgttccgttcccggtttccccaccccgttcccgttaccgtaccgttaaccggttacgtaccggtcggtacgggccgggtcggtaccggg

SEQ ID NO: 101147 - DNA, 581 bp, Homo sapiens
  misc_feature: GYAE6OF02JTG2L.15.5.A05.1.454.CMB.1.raw
  modified_base (413)..(413): a, c, t, g, unknown or other
  misc_feature (413)..(413): n is a, c, g, or t
  modified_base (574)..(574): a, c, t, g, unknown or other
  misc_feature (574)..(574): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggaccaacgccccaggacactgattatgataacaaacaacaaacactacctcgaaccctcgcccggttctcacggctcccgtcgttgggggacaaagctacgcctcgtacccttcgggtgcgacgacgccgtgacggatgagctgacgtattactgtctnctctcctatacgtggtgttcgggttgttcggcggtaggaaccgagtcgtcgaccgtcgtacgtcaacggcccaggcctcgccccgtcggtcctaccgttccgtccgttccccgtccgttaccctcgtaccctacggttacgacgttacggcggtaccgggntaccggg

SEQ ID NO: 101148 - DNA, 572 bp, Homo sapiens
  misc_feature: GYAE6OF02HGK5U.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgattatgatacaaacaacaaacactcctgacccctgcccggttctcagctcctcgtggggcaaagctcgccctcgtacccgttcggtgtcgcgacgcctgaggatgaggctagagtattacgtgtcttagctctcctagtagtggtgttcgggtgttcggcggaggaccagcgtgaccgtcgtacggtcacgcccaaggctccgcccctcggtacctacctccgttccgttaccccaccccttccctccgtcccttaaccggtacgtaccgttacggacggtccgggtcgtaccgggg

SEQ ID NO: 101149 - DNA, 536 bp, Homo sapiens
  misc_feature: GYAE6OF02IWG8D.15.5.A05.1.454.CMB.1.raw
  modified_base (153)..(153): a, c, t, g, unknown or other
  misc_feature (153)..(153): n is a, c, g, or t
  modified_base (345)..(345): a, c, t, g, unknown or other
  misc_feature (345)..(345): n is a, c, g, or t
  modified_base (428)..(428): a, c, t, g, unknown or other
  misc_feature (428)..(428): n is a, c, g, or t
  modified_base (531)..(531): a, c, t, g, unknown or other
  misc_feature (531)..(531): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactggagctgtcaccaatggtcattatccctactggttccaacagaagcctggccaagcccccaggacactgatttatgatacaaacaacaaacactcctgacccctgcccggttctcacgctccgtcgttcggggcaaagcngccctgacccgttcggcgcgcagctgagatggagcgtagagtattactgtcttgctctctatagtgtgttcgggtgttcgggnggtaggacagcgtgaccgtcgtagtcacgccgaaggctcgcccctggtccactcctcggttccccacccgtcctccgctacgtacgactcggacggtccgggntacgg

SEQ ID NO: 101150 - DNA, 688 bp, Homo sapiens
  misc_feature: GYAE6OF02I3RWJ.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgatttatgatacaaacaacaaacactcctcggacccctgcccggttctcaggcctccgtcggttgggggcaaacgctcgccctgtacccgtttcgggcgtcgcacggccgtaggaggacgtaggacggtcgtaggagttactttacgttgtcctttgccctttctacccttaagtttacggttgggtttcggtttcggggtttcggttccggggtcgggtacggggtaacccgtaaggccgttacgggtacccgttaccgtagggtaccgacggtaccccgtaaaggtcccgtccggtccccccgttacgggtccctaccgttccgttcccggtttcccccgccccttcccgttacccggtacccttaaccggtacgtacccgttacgggacgggtccggggtcgtaccgggg

SEQ ID NO: 101151 - DNA, 667 bp, Homo sapiens
  misc_feature: GYAE6OF02JX4VW.15.5.A05.1.454.CMB.1.raw
  modified_base (305)..(305): a, c, t, g, unknown or other
  misc_feature (305)..(305): n is a, c, g, or t
  modified_base (372)..(372): a, c, t, g, unknown or other
  misc_feature (372)..(372): n is a, c, g, or t
tcagtctacgtagccacgaccggtgctcgatttagatagatagacagggtcccgttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagacgcctggccaacgcccccaggaccacgtgactttatgatacaaacaacaacactccngaccctgccgtctcaggcctacccgcggtggggaccaagtctcgccctagacctagtttcgggtacncggcctagccgttcggaagggactggaggccgtagtacgtattacgtcgtcgttcgtctacgtccttagttacggttagggttcggtttacgggtttgggttccgggtacgggtacgggtaccggtaaggtccgtacggttacccggttaccgtagggtaccgacgtacccgaacggtcgtacccgtcccccggtacggttctaccgttccggttccttcccgggcccccttacccggtccggtaaccctttaccgggtaagttacccggtacgggttccggacccggggttcgg

SEQ ID NO: 101152 - DNA, 728 bp, Homo sapiens
  misc_feature: GYAE6OF02GDTYI.15.5.A05.1.454.CMB.1.raw
  modified_base (321)..(321): a, c, t, g, unknown or other
  misc_feature (321)..(321): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccaggacactgattatgatacaaacaacaaacactcctcggacccctgccccggttcncgaggcctcccgtcggttcgggggacaaacggcctcgcccgttcggtaccccgtttcggggtcgcgtcgacgccgttggaggtatggaggtcgtaggacgttattacgtcgtctttacggcttccttaccgttagttacggttcgggtttaggtttccggggtttggtttaccggggccggggtaacggggtaacccgtaaagggtccgtttaccgggaccccggttaccggttaacgggtccgtaacgggtaccccgtaaagggtccccgttaccgggcccccccgtttacggggtccctaccgttcccgtttccggtttacccccgtaacccccgtttcccgtacccggtaccgttaaccggttaaccggtaccgtacggacgggtcccggggtacgttccgggg

SEQ ID NO: 101153 - DNA, 610 bp, Homo sapiens
  misc_feature: GYAE6OF02GX83B.15.5.A05.1.454.CMB.1.raw
  modified_base (369)..(369): a, c, t, g, unknown or other
  misc_feature (369)..(369): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgatacaaacaacaaacactacctcggacccctgcccggttctcagctccctcggttgggggcaaagctgccctgtaccctttcgggtntccgcacgcctggaggatggacggcgtggagttacttactgtcttgccttctccttatacggtggtcgttcgggtgtttcgggcggacgggaccagcgtacgaccgttccgtacggtcacgtcccgaagggcctaccgccccgttcgggtacctaccgttcccgttccggttaccccgtcccgttcccgtcccgtccgttaaccggtacggtacctcggtaacggtccgggtaccgtcggg

SEQ ID NO: 101154 - DNA, 806 bp, Homo sapiens
  misc_feature: GYAE6OF02JLLH4.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctaccagcactggagctgtcaccaatggtcattactcccttactcggttaccaacaggaacgccttaggcccaaacgcccccgaaggaccactagtactttagtcgtaataaccaaaacaaaccaaaacacctacccgtacgaacccctcggaccccggttctacgacggtaccttccccgtcggttacgggggacctaaaacgtccgtacgtacccgttacgtacccgtttacggggtccgtccggacacggtccgtaggtaacggtactacggtacgggactggtaacggttacttacgttacgtcggtttctccgttaccgttaccgttaagttacgggttacgggttttgggttccggggtttagggttttccggggacccggggttaacgggtaacccgtaacgggttccctacggggtacccgttccggtttaacggacccgtacgggttaccccgaacgggttcccgtacccggtccccccgttacgggttacctaacccggttccggttttccccgttccccggttacccccgtccgtttaccgtcccggttaacggttaccggtacccggtacggtaccgggccgggttacccggtaccggg

SEQ ID NO: 101155 - DNA, 615 bp, Homo sapiens
  misc_feature: GYAE6OF02IIJE2.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgatttatgatacaaaacaacaaacactcctcggacccctgcccggttctcacggcctccgtcgttcgggggacaaacgctcgtcccgtgtaccccgtttcgggtcgcgcgacgtcctggaggtagtggagggtctagtagttactttacgtgtacgttgtccttctcttagtagttggttggttcgggttgttcgggcgggaacgggtacccaaggtcgtggacccgttccgtacggtcacgacccgaaggcctcggtccccgtggtccaccgttccgtccgttccccgcccttccctccgacgttaccgtacggtaccgtggacggtccgggctacggg

SEQ ID NO: 101156 - DNA, 548 bp, Homo sapiens
  misc_feature: GYAE6OF02IGS30.15.5.A05.1.454.CMB.1.raw
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttangatacaaacaacaaacactcctggacccctgcccggttctcaggctcctcgttgggggcaagctgccctgtacccgtttcggngcgcacgcctgaggntgaggctgagtattactgcttgctctcctatagtggtgttcgggtgttcggcggagggacaaggctgaccgtcgtaggtcacgcccaaggcctcgcccccgtggtccncgttccgtcgttcccctacccgtcctccgcctacggtcgaccgtggacggccgggctcggg

SEQ ID NO: 101157 - DNA, 584 bp, Homo sapiens
  misc_feature: GYAE6OF02GQWLJ.15.5.A05.1.454.CMB.1.raw
  modified_base (364)..(364): a, c, t, g, unknown or other
  misc_feature (364)..(364): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctcggacccctgcccgttctcaggctcctcggttggggcaaagctgccctgacccgttcgggtcncgcagcctgaggatggagcgtgagtattactgcttgcctctctatagtggttgttcgggtgttcgggcggtacgggaccaagcgtacgaccgtccgtagggtcacgcccgtaacggcctccgccccgttcggtacctaccgttaccgttccggttcccccgtacccttcccgtccgtccgttaccggtacgtaccgtcggacggtccgggtacgtacggg

SEQ ID NO: 101158 - DNA, 690 bp, Homo sapiens
  misc_feature: GYAE6OF02J0TJ2.15.5.A05.1.454.CMB.1.raw
  modified_base (145)..(145): a, c, t, g, unknown or other
  misc_feature (145)..(145): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (293)..(293): a, c, t, g, unknown or other
  misc_feature (293)..(293): n is a, c, g, or t
tcagtctacgtagccacgaccggtgctcgatttagatagatagacagggtcccgttccaatatcagcaccatggcctggactcctctctttctgttcctcctcacttgctgcccaggtccaattcccaggctgtgtgactcaggngccctcactgactgtcgtccccaggaggacagtcactctcaccctgtggcctaccngcacgtggacnctgtcaccaatggtcattactccctatcggtccaacagtaacgcctggccaacgcccccgaggtacactcgtaagttactntaatacaaaacaaaaaccacttaccacggtaccccgtacgcccgttacctacaccggtctcccgtaccggttacggggcaaaccggtccttacggcccttccggtacccgtttccgggcgtccgcacggttccgacggacgttgaccggtaggccgtagtacgttatttacgtcgtcgtttacgcttctcccgttagtggtgggtttcggttacgggtcgttcggggtaacggtcgggaccgtacggtaacgtcccgtaaccggtcctttacgggccgtaccggacccgttaaggcccgtccggtcccccctgggttaaccctcgtccgttccgtccccgttcccgtcctacccggtcttaccggttaccgcgtacggcgtcgggttccgagggacc

SEQ ID NO: 101159 - DNA, 559 bp, Homo sapiens
  misc_feature: GYAE6OF02HHHSG.15.5.A05.1.454.CMB.1.raw
  modified_base (439)..(439): a, c, t, g, unknown or other
  misc_feature (439)..(439): n is a, c, g, or t
  modified_base (521)..(521): a, c, t, g, unknown or other
  misc_feature (521)..(521): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgtgggggcaaagctgccctgaccctttcgggtcgcgcacgcctgacggatggaggctgagttattacgtgtcttgcttctcctatacgtggttgttcgggtgttcggngggacgggaccaaggctcggaccgtccgtaggtccacgcccaagggctccggcccccgtcggtaccactccgtcgttccccncctcctccgctacgtcgactcggacggcggtctacggg

SEQ ID NO: 101160 - DNA, 521 bp, Homo sapiens
  misc_feature: GYAE6OF02GCL3U.15.5.A05.1.454.CMB.1.raw
  modified_base (490)..(490): a, c, t, g, unknown or other
  misc_feature (490)..(490): n is a, c, g, or t
  modified_base (517)..(517): a, c, t, g, unknown or other
  misc_feature (517)..(517): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctcgccctgaccctttcgggtgcgcagcctgaggatgaggctgagtattactgcttgctctctatagtggtgttcgggtgttcggcggaggaccagctgaccgtctagtcagcccgaagctcgcccctcgtcactcgtcgttcccnccctcctcgctacgtgactgacgcggntcgg

SEQ ID NO: 101161 - DNA, 866 bp, Homo sapiens
  misc_feature: GYAE6OF02ICYZ6.15.5.A05.1.454.CMB.1.raw
tcagtctacgtagccacgaccggtgctcgatttagatagatagacaggggtcccttccaatatcagcaccatggcatggactcctctctttctgttcctcctcacttgctgcccagggtccaattccaggctgtggtgactcaggagccctcactgactgtgtccccaggagggacagtcactctcactgtcggctcagcactggagctgtcaccatggtcattactccctagtcggttaccaacgagaacgtaccgtcggaccctaaacggccccccgtaagggtaccacgttacgtaacttttaagtacggtaaacttaaaccaaaacctaaaccaaaacctaccgttacccgtaccgggtaccccctacggtaccccgggtttacctacgtaaccggggtcccttccccggttccggggtttacggggggacctaaaggtcccgtaccggtaccccgttaccgggttaaccccggtttccggggtcggtcccggaaccgtcggtacccgttagggacggtacgtacggacggttcgtaggtacgtttacttaccggtgtaccgttcgtacttccgttcgttaacggttcggttgggttcgggttttccggggttcggtttaccggggacggggttacgggaaccggttacgggtaccgttacggtaacccggttccggttaacgggtaccggtaaccgtacccgggtacggtacccggttccccggtccccgttaccgggttacctttaccggtttcccggttacccggtttaccccctaaccccggtttcccgttaacccggttacccgttaaccggggtacccttaaccggggtttccggacccgggtccggttacccggg

SEQ ID NO: 101162 - DNA, 558 bp, Homo sapiens
  misc_feature: GYAE6OF02H0WQT.15.5.A05.1.454.CMB.1.raw
  modified_base (425)..(425): a, c, t, g, unknown or other
  misc_feature (425)..(425): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtggctccagcactggagctgtcaccaatggtcattatcccctatggttccaacagaagcctggccaagcccccaggacactgatttatgatacaaacaacaaaacactcctggacccctgcccggttctcaggctcctcgttgggggcaaagctgccctcgacctttcgggtgcgcagcctgaggatggagctgagtatctgcttgctctctatagtgtgttcgggtgttcggnggagggacaagcgtacgtaccgtccgtaggtcacgcccgaaggcctcgccccgtcgtccgacttccgtccgttcccacccttcccgttaccgccgttaccggtacgtaccgtacggacggtccgggctacggg

SEQ ID NO: 101163 - DNA, 882 bp, Homo sapiens
  misc_feature: GYAE6OF02J3N29.15.5.A05.1.454.CMB.1.raw
tcagtctacgtagccacgaccggtgctcgatttagatagatagacaggggtcccttccaatatcagcaccatggcctggactcctctctttctgttcctcctcacttgctgccaggtccaattcccaggctgtggtgactcaggagccctcactgactgtcgtccccaggagggacagtcactctcacctgtggcctccagcactggagctgtcaccaatcggtacacttactcccttacgtcggttacccaaacgacggtaacgcccgtacgggacccaaaccggccccccgaaggacctaccgttaggtaacttttagtacgaactaaaccaaaaccaaaccaaacctaccttcccgtaccggaccctcggtccccggtttctaccgacggtcccttacccgttcgggttacgggggacaacggtccgtccggtccccgttacggtaccccggttttggggaccgtcggtacccgtacggtcccggtaggtaacggtacgttacgggtacgggtacgttacggtaacgttttaacgttccgttacgttccgtttcgtacccgtttaccttaacccgtttaagggttaacgggttcggggtttcgggtttacgggggttaccggggtttaccggggaccgggaaacggggttacccgtaggttacccgggtccggttaacccgggttaccgttacgggtacccgtaaccggtacccggtaaccggtcccggttaccccgtccccgggttaccgttacccgtacccggtttacccgttaacccccggttccccgtaccccgttaccccgttaccggtaccggtttaacccggttaacggtacccggttcggggtacccggaccggggttaccgtaacccggg

SEQ ID NO: 101164 - DNA, 690 bp, Homo sapiens
  misc_feature: GYAE6OF02GQCAP.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactcggttccaacagaacgcctggacccaacgcccccaaggaccactgtattatagataacaaacaacaaacacctcctacggacccctgtccccggttctcgacggtcctccgtcgggttggggaccaaagcctacggccctacggtacccgtttcgggtcgcgacgcgtccgtaggaggtacgtggacggtcgtagtagttacgtttacgtcgtcgttcgccttcttaccttagttggttggtttcgggttcgggttcgggttcgggacgggtacgggtaaccgaacgggtccgtacgggtacccgttaccggtacggtaccgacggtaccccgaacgggtcctcccgtcccccgttaggttaccgtacttttcccgtacccgtttcccctaccccgtcccgttaccgtaccgttaccgtacggtaccgtcgggaccggtaccgggcgtaccggg

SEQ ID NO: 101165 - DNA, 738 bp, Homo sapiens
  misc_feature: GYAE6OF02GOXU2.15.5.A05.1.454.CMB.1.raw
  modified_base (287)..(287): a, c, t, g, unknown or other
  misc_feature (287)..(287): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaacagaacgcctggcccaacgcccccaggaccactgtatttangaactaacaaaacaacaaacactaccgtacggacccctcggccccggttacctcgacggtcctcccgttcgggttacgggggaccaaacgtccgtacgccccttacggtaccccgtttcgggtacgtccggacgacgccgtaggacggacgttcggacggtcgtaggtacgttaacgtttacgtcgtcgtttcgccttcctacttagttacgggttcgggtttcgggtttcggggttcggtttcggggaccggggtaacgggtacccgtaacgggtccgttacgggtaacccggttaccgttaacgggttccgaaccggtacccgtaacggtcccgtacccggtcccccgttcggttaccctaccgttcccggttcccggttcccccgtcccgttcccgtaccgtacccgttacggtaccgtaccgtacggaccgggtccgggcgtacggg

SEQ ID NO: 101166 - DNA, 560 bp, Homo sapiens
  misc_feature: GYAE6OF02JFNOF.15.5.A05.1.454.CMB.1.raw
  modified_base (455)..(455): a, c, t, g, unknown or other
  misc_feature (455)..(455): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcctactggttaccaacagaagcctggccaagcccccaggacactgatttatgataacaaacaacaaacactcctcgaccctcgcccggttctcacggcctcccgtcggtcgggggacaaggcctacgcccgtcgtacccgttcgggtcgcgcgacgccgtgaggagtggaggcgtgagtattactgtcttgctctctactggtggttgttcgggtgttcgggcggnggaccgagcgtcgaccgttcgacggtcacgaccgacgctcgcccgtcgcnctcgtccgtcccncctccgtcgtccgtacgtacgacgttcgcggtcggcgtacgg

SEQ ID NO: 101167 - DNA, 610 bp, Homo sapiens
  misc_feature: GYAE6OF02F0IJU.15.5.A05.1.454.CMB.1.raw
  modified_base (282)..(282): a, c, t, g, unknown or other
  misc_feature (282)..(282): n is a, c, g, or t
  modified_base (323)..(323): a, c, t, g, unknown or other
  misc_feature (323)..(323): n is a, c, g, or t
  modified_base (584)..(584): a, c, t, g, unknown or other
  misc_feature (584)..(584): n is a, c, g, or t
  modified_base (604)..(604): a, c, t, g, unknown or other
  misc_feature (604)..(604): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctggtggtgactcaggagccctcactgactgtgtccccaggagggacagtcactctcacctgtggctccagcactggagctgtcaccaatggtcattactcctactggttaccaacagaacgcctggccaagcccccaggacactgatttangataacaaacaacaaacactcctacggaccctcgccgttcncacggctccgtcggttcgggacaaagtctcgcctcgtacccgtttcgggtcgcgcacgtcctggaggagtggacggctaggagttattacgtgcgttgcttctactagtaggttggttcggttcgggttggttcgggacgggtacgggacctaaggcgttacggtaccgtaccgtacgggtcacggtacccgaacggccgtccgccccgttacggtctaccgtttccgttcccctacccttccgtaccgtcctacggtacnccgttacgcgggtcggtcgnggaccg

SEQ ID NO: 101168 - DNA, 558 bp, Homo sapiens
  misc_feature: GYAE6OF02JAQJV.15.5.A05.1.454.CMB.1.raw
  modified_base (250)..(250): a, c, t, g, unknown or other
  misc_feature (250)..(250): n is a, c, g, or t
  modified_base (381)..(381): a, c, t, g, unknown or other
  misc_feature (381)..(381): n is a, c, g, or t
  modified_base (550)..(550): a, c, t, g, unknown or other
  misc_feature (550)..(550): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaancctggccaagcccccaggacactgatttatgatacaaacaacaaacactctggaccctgcccggttctcaggctccctcgttgggggcaaagctgccctgtacctttcgggtgcgtcagcctgaggatggngcgtgagtattactgtcttgcttctcctatagtgtgttgggtgttcgggcggaggacagctcgaccgtccgtagtcgagcccgaaggcctcgccccgtcggtcctacgtccgttcggtccccgtcccttacctccgtacgtaccgtacggaacgtggacggaccgggtntaccgggg

SEQ ID NO: 101169 - DNA, 656 bp, Homo sapiens
  misc_feature: GYAE6OF02IOHB9.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggttaccaacagaagcctggaccaacgcccccaggaccactgatttatgtataacaaaacaacaaacacctcctacggacccctgccccggttctcacggcctcccgtcggttgggggcaaagctcgcccgtcgtaccccgtttcgggtcgcgccaggtccctaggacgggtatggacgggtctaggagttaactttacgtggtcttacgcttccttccttaagttaggttacgggttggtttcggggttggttcgggacgggagggaccgaaggtcgtcggtaccgtccgtaggtccgacgacccgaacggtcctccgtcccccgtacggtccaccgttccgttccgttcccccacccgttcccgtccgtacccgttacgttacggaccgttcggaacggtccgggaccgtacgggg

SEQ ID NO: 101170 - DNA, 729 bp, Homo sapiens
  misc_feature: GYAE6OF02IXGE8.15.5.A05.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (406)..(406): a, c, t, g, unknown or other
  misc_feature (406)..(406): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtcgtccccaggagggacagtcactctcactgtggctccagcnctggacnctgtcaaccaagtggtactatttactaccctacgttacggttaccaacagaacgcctggaccaaccgccccgaggacnctgtattatagactaacgaacaaacaactcctactacggaccctcgtccggttccncgtacgcctaccgtcggttcggggactaacgcgtcgcctacgtaccccggttggcgtcgacgnggtccgtagacggatcggacgtcgtacggtaagttacttcgtcgttacttcggacttccttacgtaccgtttaaggtcgggtttcgggtttacgggtttcggtaccggggtacgggtaacggggtaaccacgggttaccgttaccggtacccggttaccggttaccgggccgtaaccggtaacccgaccggttaccggtcccgtaccccgttaccgggttaccctaacggttcccgtttacccgttaccccgcccctttacccggtaccgttaccgtacggttaccggaccgtttacgggaccgggtaccggtccggtaacgg

SEQ ID NO: 101171 - DNA, 816 bp, Homo sapiens
  misc_feature: GYAE6OF02GO3X5.15.5.A05.1.454.CMB.1.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtgtccccaggagggacaggtcactctcaccgtgtcggctccagcactgggagcgtgtaccaccaagtggtacacttactccccttacgtcggttacccaanacgaagcctggacccaacgcccccaggacactgtattangaactaacaaaacaacgaaaccaccgtaccgtacggaccccctcggtaccccgttctcgacggtcctcccgtcgggttggggacctaaacggccgttaccggcccgttacggttaccccgtttcgggtcgccgacgtacggtccgtaggtagggacgtagggacggtcgttacgtaacgttaacgtttacgtcggttaccgttcggtcttccgttaccgttacggtttacgggttgggttacggggtttcggggttaccgggttttacgggggaccgggtacggggtaaccgtaaacgggtccggtttaaccgggtacccggttacccgttacgggtacccgtaacccggtacccggtacccggtacccccgtttaaacccgggtcccggtttaaccgtaccgttacccggtttccccggttaccccgtccccgtttaccccggtccggttaccggttaaccggtaccggttacggttccgggaaccggttccggggtacgttacgggaacccggg

SEQ ID NO: 101172 - DNA, 638 bp, Homo sapiens
  misc_feature: GYAE6OF02H7PTZ.15.5.A05.1.454.CMB.1.raw
  modified_base (633)..(633): a, c, t, g, unknown or other
  misc_feature (633)..(633): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcacgtggagctgtaccaccaagttggtcaatttactccctatcggttaccaacagaacgcctacggccaacgcccccgaaggaccactagtactttaatgataacaaaactaaccaaaacactacccgtacgaccctcgtaccccgttctccgacggtccttcccgtacggttcggggaccaaagcgtcgccctcgtacccgttcgggtcgcgcacggccgtgacggacgtggagtcgtggtagttacgtttacgtcgtcttcgtacttcgtaccttaagttaggttgggttcggtttacggggttggttcgggtacggtaacggggtaccgaacgtcgtacgtacccggttcgtacgtcgacgccgtacgcgtccgccctcgctctcgtcctacctcctccgtacgtacgtacgtacgcgtgacgtccggntacgg

SEQ ID NO: 101173 - DNA, 710 bp, Homo sapiens
  misc_feature: GYAE6OF02HH5QS.15.5.A05.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctggtggtgactcaggagccctcactgactgtcgtcccaggagggacagtcactctcacctgtgctccagcacgtgganctgtacaccaatggtcattacncccttagtcggttaccaacagacgccgtacggaccaacgcccccaggacactgtaattatagaactaaacaaaactaaccaaacaccttaccgtacggacccctcggtccccggttctcgacggtcctcccgttcgggttacggggaacgaacgtcgtaccgtcccgttaccggtacccggtttcgggcgtcccgacgtacggtccgtaggacggtagtacggtacggtcgtagtacgttacgttacgtcgtacgttcgtcgtccttacttagttacggttgggttcgggttcgggtttcgggttcgggtacgggtacgggtaaccggaacggtcgtaccggtaccggttaccgtacggtaccgacgaccgacggtccgtcccgtccccgtaccgtccgtaccgttccgttcccgttacccgtaccctccgtccgtaccgtacggtacggtacgacggtttttacggcggtcggtcgg

SEQ ID NO: 101174 - DNA, 814 bp, Homo sapiens
  misc_feature: GYAE6OF02JLHFE.15.5.A05.1.454.CMB.1.raw
  modified_base (262)..(262): a, c, t, g, unknown or other
  misc_feature (262)..(262): n is a, c, g, or t
  modified_base (764)..(764): a, c, t, g, unknown or other
  misc_feature (764)..(764): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcgaggacgccctcactgactgtcgtcccgaggaggacagtcactctcacctgtcgctccagcacgtggagctgtcaccaagtggtccattactcccttacgtggttaccaacaggtaacnccgtacggaccaaacgcccccgaacggactaccgtgtaactttagtagtaactaactaaaaaccaaaccaaaaccaccgttacccgtaaccgggtaacccccgtcggttaccccccggttcctaccgtaacggtcccgttaccccgttcggggttcgggggaccgtaaaacggtccgttccgaccccgttacggtaacccgttaacggttttccggggtacggtaccggtaacggtccggtaacgggtaacgggtacgttacgggaccgggtacgttacgggttaacgttaacgttttacgtcggttaccgtttcggtccgttacccgttacgttaacgttacgggttcgggtttcgggttcggggttaccgggtttaccggggtaacggggacgggttaaccgagttccggtaccgtaccgttaccgtacgggtacccgacggtacccgaacggcgttacccgccccgttacggtccgtaccgttccgtacccggttcccncccgtcccttcgtaccgtacgtacggtccacggacgttacgggctacggg

SEQ ID NO: 101175 - DNA, 667 bp, Homo sapiens
  misc_feature: GYAE6OF02GCWC2.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtgtcccaggaggacagtcactctcacctgtggctccagcactggagctgtcaccaatggtcattactcctactcggttaccaacagaagcctggaccaacgcccccaggaccactgtattatgatacaaacaacaaacactcctacgaccctgcccgttctcacgtcctcctcggtggggacaacgctcgcctcgtaccgttcggcgcgcacgccgtggagtagtggacggtcgtagtacgttaacttacgtgtctttcggtccttcgtaccttagttacggttgggttcggtttcggggttcgggtttcgggaccggggtaacgggaacccgtaggtaccgtaccgggtacccggttaccggtaacgggttaccgaaccggacccgtaacggtcccgtcccggtccccgttaccggttcctaccgttacccgttccgttacccccgtacccttcccgtacccgtaccgtaccggtacgtaaccgtggaccggtccggcgtaccggg

SEQ ID NO: 101176 - DNA, 797 bp, Homo sapiens
  misc_feature: GYAE6OF02G54LK.15.5.A05.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
tcagtctacgtagccacgaccggtgctcgatttagatagatagacaggggtcccgttccaatatcagcaccatggcctggactcctctctttctgttcctcctcacttgctgccaggtccaattcccaggctgtggtgactcaggagccctcactgactgtgtccccaggagggacagtcactctcacctgtggctccagcactgganctgtcaaccatgtcattacncccttagtcggttaccaacagaacgtccgtacggaccaacggacccccagggaacctaccgtagtattttaagacgtaataaacaaaaccgaaaacaaaccacgtaccctaccggacccctcgtaccccggtttcaccgaacggcccttcccgttcgggttacgggggaccaaaggtcctcgacccgttcggtacccgtttcgggcgtcgaccgtacgccgttacgggagtacgtacggacgtacgtgtacgttaatttaccgtcggtacgttcgtccttaccgttaccgttaggttacgttcgggtttacggtttacggggttcgggtttaccgggaccggggtaacggggtaaccggtaacggtaccgttaccgggtacccggtttaccggtaaccgggttaccgaacccgggtacccgtaaccgggtacccttcccgggtacccccgttcccggttacccgtaaccgtttccccgttacccgggttccccgttcccgtccccgtccgttaccgttaacccggtacggttaccgtaccgggtacggtaccggggtcctaaccggggg

SEQ ID NO: 101177 - DNA, 565 bp, Homo sapiens
  misc_feature: GYAE6OF02FNF39.15.5.A05.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (548)..(548): a, c, t, g, unknown or other
  misc_feature (548)..(548): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcacatgtcattactcctactggttaccaanagaacgccgtggacccaagcccccgaggaccactgatttactgactaacaaacaacaaacactcctcggacccctggcccggttctcacggccttccgtcggttggggacaagctcgcctcgtccttcgggncgcacgcngagngtgagcgngatatntgctgctctactatagtggttcgttcgggtgttcgggacgacgggtacagcgtcgaccgtcgtagtccagcccgtaagcctccgtccccgtcgtaccacttccgtccggtccctccccttcctccgtaccttaacggtcgtaaccgnggacggtcggcgtacgg

SEQ ID NO: 101178 - DNA, 669 bp, Homo sapiens
  misc_feature: GYAE6OF02HB68V.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggtccaacagaacgcctggccaacgcccccaggaccactgatttatgataacaaacaacaaactactcctacggacccctgcccgttctcacggcctccgtcggttggggacaagctcgaccctcgtacccgtttgggcgtcgcacgtcgtgacggatcgggagtcgtagtaacgttacttacgtgtccgttcgtccttcttaccgttagtacggttcgggttcggtttacggggttcgttccggggagggtaacggggaaccctaggtccgtcggaacccggttcgtaacgtcgaaccggtacccgaagggtcccgtacccgtcccccggtcgtaccctcgtcccgtttcccgtaccccctacccgttcccgttaccgtaccgttaaccgttacggtaccgtacgggtacggtccggggtctaccggggg

SEQ ID NO: 101179 - DNA, 670 bp, Homo sapiens
  misc_feature: GYAE6OF02ICL8I.15.5.A05.1.454.CMB.1.raw
  modified_base (216)..(216): a, c, t, g, unknown or other
  misc_feature (216)..(216): n is a, c, g, or t
  modified_base (308)..(308): a, c, t, g, unknown or other
  misc_feature (308)..(308): n is a, c, g, or t
  modified_base (423)..(423): a, c, t, g, unknown or other
  misc_feature (423)..(423): n is a, c, g, or t
tcagtctacgtagccacgaccggtgctcgatttagatagatagacaggggtcccttccaatatcagcaccatggcctggactcctctctttctgttcctcctcacttgctgccagggtccaattcccaggctgtggtgactcaggacgccctcactgacctgtcgtccccgagggaggactgtcactctcacctggtcggcctccagcacgtgganctcgtcaacctaagtcggtctattactcccttagtcggttaccaacgacgaagccgtaggacccacggccccgaaggacctcgagtatttanacgtaacaaccaaaacaacaaactacctaccgtacggaaccctcggtcccgtacgtcgacgtcgtccgtcggtcgggacaacggctcgacctcggtacccgttcggcgtcgtacncgtccgtagtgaacggtgacgtcgtacgttacgtacgttacgtcggtcctacgtccttacgttacgttacgtaggttcgggttcggttacgggtttcgggttaccgcggggtaacggtccgaacgtcgtccgtaccgtcgacgttcgaccgcgacgtccgtccgtcccgccgttactccgtcggtcccttaccgtcccttacttccgtttaacggctaccggtacgtcggcggtccgtaggaaccgg

SEQ ID NO: 101180 - DNA, 879 bp, Homo sapiens
  misc_feature: GYAE6OF02J2129.15.5.A05.1.454.CMB.1.raw
  modified_base (133)..(133): a, c, t, g, unknown or other
  misc_feature (133)..(133): n is a, c, g, or t
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (219)..(219): a, c, t, g, unknown or other
  misc_feature (219)..(219): n is a, c, g, or t
tcagtctacgtagccacgaccggtgctcgatttagatagatagacagggtcccttccaatatcagcaccatggcctggactcctctctttctgttcctcctcacttgctgcccaggtccaattcccaggctgngtgactcagganccctnactgactgtacgtcccaggaggactaggtcaactcgtacaccgttgtcggccttccgagcaccgtgganccgtagtccacgtaagtcggtacaattctacccgtactggttacccaacagaactccgtacggaccgaaccgtcccccgaggtacctacgtacgtacgtttagtacgtaactaactaaaacctaacctaaaccgtaccgtaaccgttccggtaacccccggtccgttaaccccgggtttccgtaaccggtcggtaccccggttcccgttaccgggttaccggggtaacgtaaaacggtcccgttaaccggtaccccttacgggtaacccggttaccgtttcggggtacgttacccggaaccgtacggtaccgttacgggaacggttaccggtacgacggtccggttaaggtaacgttaccggttaccgttacggttaacctcgttacccgttaccgttacgtttaacggtaccgggtttggttacgggttttccgggtaacgggttttaccggaccggggtaacgtacccgtaaacggttccgtacccggttaccgggtacggtaccgtaccgtacggtacccggtaacggttcctaccgggttacccccgttggtaccgttaccggttccccggttaccgtaccccgttaacccgttcccgtaccggtttaccgtaccgttaccgttaaccggccgggtaaccggttccggtacccggg

SEQ ID NO: 101181 - DNA, 716 bp, Homo sapiens
  misc_feature: GYAE6OF02HL4BY.15.5.A05.1.454.CMB.1.raw
tcagtctacgtagccacgaccggtgctcgattttagatagatagacaggggtcccttccaatatcagcaccatggcctggactcctctctttctgttcctcctcacttgctgcccagggtccaattcccaggctggtggtgactcaggagccctcactgactgtgtccccaggagggacagtcactctcacctgtgctccagcactggagctgtcaccaatggtctattactcccttacgtcggttaccaacgtagaacgccgtcggaccaacgcccccgaaggacctacgtagtaatttatagtaactaaaccaaaacgaaaaccaaaaccaccttacccgtaccggaaccccttcggtccccggttctaccgacgggtcccttccgttcgggtcgggggacaacgtccgtacgtcccgtcgtacccgtttcggggtcgcccgcgtacgccgtaggagtacgtggaggtcgtagtacgttacttacgtgtcttcgcttctacgtagttggtcggttggttcgggttcgttcgggcgggtaacgggaccgaacggtcgtaccggttacccgtaccgtacggtctaaccggaccgtaacggtccgtacccgtacccccgttcggttacctccgttccggttcccgtcccccggttccgtcccttacggtcccgtaacgttacggtaccgtcgggacgggtccggtaccgtaccgggg

SEQ ID NO: 101182 - DNA, 610 bp, Homo sapiens
  misc_feature: GYAE6OF02IKKDX.15.5.A05.1.454.CMB.1.raw
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattactcctactgttaccaacagaagcctggccaagcccccaggacacctgatttatgatacaaaacaacaaacactacctcggacccctgcccggttctccagcctcctcggttgggggcaagctacgccctcgtacccgtttccgggtgccgcacgctgaggntggaggctgagttacttagtcnttgcttctcctagtagttggtgtttgggttggttcggcgggtacgggaccaaggtcgtacggaccgttcccgtagggttccgacgacccgaagggtcctaccggtcccccgtcggttaccaccttccgttcccggttccccgccccgttcccgaccgtccttaccggtacggtacctggaccggtcgggtcgtacggg

SEQ ID NO: 101183 - DNA, 767 bp, Homo sapiens
  misc_feature: GYAE6OF02F9SZW.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggagccctcactgactgtcgtccccaggagggacagtcactctcacctgtggcctccgagcactggagctgtcacaagtggtcattactcccttacgttcggttaccaacgagaacgccgtcggaccaacgcccccgaggaccactgtactttatacgtactaacaaaaccaaacaaacctactaccgtaccggtaacccctcgtaccccggtttcaccgacggtcccttacccggttcgggttacgggggaccaaacggtcctcggtccccgttacggtaccccggtttcggggtcgccgcgacgtccgtaggaggacggtaggacggtacgtaggtaacgttacgtttacgtggtctttcggtaccttccgtaccgttaagttacgggttcggggtttacgggtttccggggttcgggttacggggaccggggtaacgggaccgtaacggtcgttaccggtacccggtacgttaccggacgaccggtacccgaaacgggtccgtacccggtaccccgttcggttccctaccggtttccgttccccggtttaccccctaccgttccccgttaccgtaaccgttaccggtacggttacgtcggaccgggtcgggtccgtacggg

SEQ ID NO: 101184 - DNA, 800 bp, Homo sapiens
  misc_feature: GYAE6OF02JG9QH.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcgaggcgccctcactgactgtcgtccccgagggagggactagtcactctcacctggtggctccgagcacgtggagctgccaaccgtaagtcggtactattactcccttacgttcggttaccaaacgaagacgtccgtacggacccaaccggccccgaaggacctacgtagtaatttacgacgaactaaccaaaacctaaacgaaacctactccgaccggtaaccccttcgggtaccccgttctacggaaccgtcccgttaccggtcgggttacgggggaactaaacgggtcctaccggtcccgttacggtacccgttggggtaccgtcggacgtacggtccgtaggtacggtaacgtcggggacgttcgtaggtaacgttacttcgtacgtcgtacgtcgttacgtaccgttagttacggtgggttcggttacgggttcggtacgggtaccgggtacggtactaagggtcgtacggtacccgtacggtacggtaccgtaccggtaccggtaacggccgttaccccggtacccgttccggtaaccgttccgttacccggtttccccggttaccccttacccggttacccgtacccggtaaccgttaaccggtaccggttaccggttaaccgggtccgggttacggtcccggtaaccggg

SEQ ID NO: 101185 - DNA, 752 bp, Homo sapiens
  misc_feature: GYAE6OF02F8OEA.15.5.A05.1.454.CMB.1.raw
  modified_base (264)..(264): a, c, t, g, unknown or other
  misc_feature (264)..(264): n is a, c, g, or t
tcagtctacgtagccacgaccggtgctcgatttagatagatagacaggggtcccttccaatatcagcaccatggcctggactcctctctttctgttcctcctcacttgctgcccaggtccaattccaggctgtggtgactcaggacgccctcactgactgtcgtcccaggacggacagtcactctcacctgtcggcctccagtcaccgtgggacgtctcggtaccaccaagtcggttcattactcccttacgtcggttaccaanacgtaacgccgttacggccaaccggacccccaagggtaacctaccgttagttaactttaagttacgacttaaccgaaaactaaactaaaccgtacctccgttaccgaccccgttaccgtacccggtttcaccgtacggtacccttacccggttcggttacggggactaaacggtcctcggacccttcggttacccgtttcggaccgtcccgacgtaccgtaccgtacgaacgggttactacggcggttacgtacgtagtttacttacggtcgttcgttcgtacgttacctacgttacgtaggttcgggttgttacgggttcggttcgggtaccggacggacctacgtcgttacgtaacccgttcgttacgcgacccggtacgaacgtccgtaccggttcccgtcgtacgtaccgttccgtcccggttccccgtccctccgttacgaccgtacggtacctaccgtggtacccggacggtcgttaccggg

SEQ ID NO: 101186 - DNA, 689 bp, Homo sapiens
  misc_feature: GYAE6OF02JVGIK.15.5.A05.1.454.CMB.1.raw
  modified_base (146)..(146): a, c, t, g, unknown or other
  misc_feature (146)..(146): n is a, c, g, or t
  modified_base (203)..(203): a, c, t, g, unknown or other
  misc_feature (203)..(203): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggngccctcacctgactcgtgtccccaggagggacagtcacctctcacctgtcgctaccngcactggagctgtaccacctaatggtcattacgtccctacgtggttaccaacagtaacgcctacggaccacgaccccccaggtaccaacctgtaactttacgagtactaactaaaccaaaccgtaacactaccgtagaccccttgaccccgttcctacgaggtaccctcccgtcggtacgggggcaaacgtccacggtccctacggtaccccgtttggggactccgacgtcggtacccgttggacggtaatccgggaagtccgtaggtacgttactacgttcgttctagtccgtctaccgttagtcggttacggtcggttacgggtccggtttcgaccggggtcggacgtacgtcgtacggtacccggtctacggtacgcgtaccgtaacgccgccgtaccccgtcggtacctccgttaccgtcgtacccttacccgtccctccggtacttaccgttcggtacctaggtaccggacgtcggtacgg

SEQ ID NO: 101187 - DNA, 779 bp, Homo sapiens
  misc_feature: GYAE6OF02IYEPI.15.5.A05.1.454.CMB.1.raw
  modified_base (299)..(299): a, c, t, g, unknown or other
  misc_feature (299)..(299): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctggtggtgactcaggagcccctcacctgactgtcgtcccccaggagggacagtccactctcacctgtgctccagcactggagctgtcaaccaatggtcattactccctacgtcggttaccaacagaagccgtcggaccaaccgcccccaggaccactagtactttangaactaacaaacaaacaaactactaccgtaccgacccctcgtccccggttctccgtacggtcccttacccgttcgggttaccggggggacgtaaacggtccgtccggtaccccgttacggttacccccggttttcggggtccggaccggtacgaccggtcccgttagggaacggtaggtacgggacgggtaccggttagtaacgtttaacgtttaccgtacgtcggtttcgtaccgttccgttaacccgtttgttaacgggttggggtttcgggttttcgggggttacggtttccgggtacgggggtaaccgggaaccgtaacgggtcgtacccgtacccgggtttaccgtacggtccgaaccgacccgaacggttcccgtcccgggtccccgtacgtccgtaccgttcccgttccgttccccctacccgtcccgtcgtaacccgttcgtacgacgttcggtaccgggcggtcgtccggg

SEQ ID NO: 101188 - DNA, 803 bp, Homo sapiens
  misc_feature: GYAE6OF02H9I93.15.5.A05.1.454.CMB.1.raw
  modified_base (212)..(212): a, c, t, g, unknown or other
  misc_feature (212)..(212): n is a, c, g, or t
tcagtctacgtagccacgaccggtgctcgatttagatagatagacaggggtcccttccaatatcagcaccatggcctggactcctctctttctgttcctcctcacttgctgcccaggtccaatcccaggctgtggtgactcaggagccctcactgactgtcgtccccaggagggacagtcactctccaccgtgtggctccgagcactggganctgtcacctaatggtcacttatcccgtacgttcggttaccaacgacggaacgtccgtcggacctaacggccccccgagggacctacgttaggtaactttacgtacgtaactaaaccaaaacaaaaccgaaaacctaccgttacccgttacggacccccgttacggtaccccggtttaccgtaccgaacggttccctaacccccggttgggtttaccggggggacctaaaacggtccgttaccgtaccccgttacggttaaccccgggtttcgggtcggccgacgtaccgtccgtacggacggtacgtacggacggtcgttaggtaacgtttacgttaacgtcggttaccgttcgtaccgttccgttaccgttaacgttacgggttgggtttaccgggtttcggggtttccggttacgggggtaccgggaacgggtacccgtaaggtcgtaccggtacccggttcgtacggtaccgtacggacccgtagtcccgtccggccccttaggtaccctccgtttaccgtcggttacccccgtccgtccccgtcgtaccgttacgtacgacggtccggacgggtccggcctacgggg

SEQ ID NO: 101189 - DNA, 750 bp, Homo sapiens
  misc_feature: GYAE6OF02F2DB7.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcgactgactgtgtccccaggagggacagtcactctcacctgtggcctccagcacgtcggagctgtacaccgaattggtactattactcccgtacgtcgttaccaacaggaacgcctaggaccaacgtcccccaaggaccaccgtagtacttagtagaactaaacaaaactaaacgaaacctaccgtaccgtaccggaccccttcggtacccggttcgtaccgacggtccctacccggttcgggttacggggaacctaaacggtcctaccggtacccgttaccggttaaccccggtttcggggtaccgacccggttaccgaccggtaccgtacggacggtacgttacggacggtacggtacgtaagtttacgttacgtcggtaccgttaggtccttaccgtacttacggttacgggttcggtttcgggtttaccgggttcggtttaccggggacggggtaacgtaccggtaacgtccggtacgtaccggtcgtacggtacgccggacgtacgtccgtccgtcccgttgaccgtctccgttaccgcccttaccgtcctacggaccgttacggtcgacggtacgacggtccgtcggtacgg

SEQ ID NO: 101190 - DNA, 768 bp, Homo sapiens
  misc_feature: GYAE6OF02JFAAK.15.5.A05.1.454.CMB.1.raw
  modified_base (193)..(193): a, c, t, g, unknown or other
  misc_feature (193)..(193): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgnggctccagcactggagctgtcaccaatggtacattactccctactcggttaccaacagaacgcctacggacccaaccgcccccgaaggaaccactacgtaactttatacgtaataaaccaaaacaaaccaaaaccaccttacccgtaccggaaccccctcggtccccggttctaccgacggtcccttcccgttcgggttacgggggacaaacggtcctacgtccccgtacgttcccgtttcgggcgccgcgtacggcccgtggacggtagtacggacggtcgtgtacgtttactaccgtgttacgttcgcttaccttccgttagtggtttacgggttcgggtttacgggttcgggttcccgggggacggggtacggggtaaccctaacgggtcgttaccgggtacccggttacccgttaccgggtaccgaaccggtacccggaacggtccctacccggtcccccgttcgggtcctacccggttccgtttccccggttccccctaccccgttcccgtacccgtaccggttaaccggtacgttacgaccggtaccgggccggggttaccgtaccggg

SEQ ID NO: 101191 - DNA, 681 bp, Homo sapiens
  misc_feature: GYAE6OF02JY1EE.15.5.A05.1.454.CMB.1.raw
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (553)..(553): a, c, t, g, unknown or other
  misc_feature (553)..(553): n is a, c, g, or t
  modified_base (675)..(675): a, c, t, g, unknown or other
  misc_feature (675)..(675): n is a, c, g, or t
tcagtctacgtagccacgaccggtgctcgatttagatagatagacagggtccgttccaatatcagcaccatggcctggactcctctctttctgttcctcctcacttgctgcccaggtccaattccagctgtgtgactcaggcgcctcactgactgtcgtcccaggacgggcagtcactctcaccgtgtcggcctcaggctacgtcggagcctgccgaccaagtcggtctaacttactaccttaccgtggttaccaacgaacggacgtccgtacggaccgaaccgcccccgtaaggaacctacttacggtattttaccgttaggaacttaaaccgaaaactaaactaaaccgttacctaccgtaccggtaacccgttcggtacccgttttccacggtacgtccttaccgtcggttcggggaaccaaggtcctcgccgtcgtaccgttggacgtcagcgtcgtgacggtagcgtaaggtctagtcttagttccngtaccgttnccgtnttacgagtcgtaggtcggttacggtccgttaggcggtagaccggtancggttacgaccggtactcggaccgtacgtccgacggtttccgtaccccggcctaacccgggttacccgtccgtacccggtccctaccggttcaccgtacgtacgtcaacgtcgaggttccgngacccg

SEQ ID NO: 101192 - DNA, 811 bp, Homo sapiens
  misc_feature: GYAE6OF02I391H.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtcggctccagcacgtggagctgtccaacctaagtggtctaattactcccttacgttcggtaccaacgagaacgtccgtggacccaaccgcccccgaaggaaccacgtacgtaattttacagaacttaaaccaaaaccaaacctaaaacctaccttacccgtaccggtaaccccgttaccggtaccccggtttacctaccgaaccggtcccttaccccggttccgggttacgggggaacctaaacggtccgttaccgtccccgttacggttaccccgtttcggggaccgtccgtacgtaacgccgtaggtacggtaacggttaggacgggtcgttacggtaacgtttaacgttacgttcgtaccgtttcggttaccctttacgtttaccgttaaggtttacgggtttcgggtttcgggtttaccgggttcgggtttacggggaccggggtaaaccggtaccgtacggtaccgttaccggtaccgttaccggtacggtaccgacgtacccgtaacgccgttcccgcccgttcggtcctaccgttccgtcccggtacccctcccgtaccgttccgtaccgtaccgtacggtaccgtacgggtaccggccgggtactacggg

SEQ ID NO: 101193 - DNA, 758 bp, Homo sapiens
  misc_feature: GYAE6OF02F53JZ.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactgtcgtccccaggtagggacagtcactctcacctgtggcctcagcagtggagctgtcaccagtgtcattactccctacgtcggttaccaacgagaacgccgtggaccctaacgacccccaggaccacgtaggtactttagtcgtaactaaaccaaaacaaaacctaaaacctacccgtaccccgttaccggtacccccttacgggtacccccggtttacctacgtaacccggttacccttcccccggtttacggggtttaccgggggggaacctaaaaccggtcccgttaccggaccccgttacggttacccccggtttccggggtacgcccggtactaccggtcccgtaggacgggtaacgtggacggtcgtaggtacgttaactcgtgtacttgtccttctacgtagttacggttgtcggttcgggtcggttcggcgggtacggtacgacgtcgtccgacgttacgtacgacgaccggtcctaacggtctcccgtaccccgttcgtaccgtccgttccgtacccgttccccttacccgtaccgttacccgttaacgtccgtaacgtaccggtaggaccgggtccgttacgggaccgg

SEQ ID NO: 101194 - DNA, 859 bp, Homo sapiens
  misc_feature: GYAE6OF02FLT48.15.5.A05.1.454.CMB.1.raw
  modified_base (153)..(153): a, c, t, g, unknown or other
  misc_feature (153)..(153): n is a, c, g, or t
  modified_base (215)..(215): a, c, t, g, unknown or other
  misc_feature (215)..(215): n is a, c, g, or t
tcagtctacgtagccacgaccggtgctcgatttagatagatagacaggggtcccttccaatatcagcaccatggcctggactcctctctttctgttcctcctcacttgctgcccagggtccaattcctaggctgtggtgactcaggagccctnactgactggtcgtccccaggagggacagtcactctcacctgtggctccagcacgtggagctntacacaatggtctattactccctatcggttaccaacgagaacgcctacggacccaacgcccccgaaggacctactacgtaatttactagaactaaaccaaaacgtaaaaccaaacctaccgtaccgtaccggtaaccccgtcgtccgttccgtttaccgtaccgaccgggtaccctttacccgggtcggggttacggggtaacaaaccggtccgttaccgtcccggttaccgttacccgggtttacggggaccgtccgtaccgtaccggacggtacgggtacggtacggtacgggtacggtacgtaaggttacgttaacgtttccggtacggttccgttaccgtacctttacccgttacgttagggttacgggtttggggttaccggggttcggggtttacgggggacccgggttacggggaacgggttaacccgggtaaggttaccggtaaccgggttacccggtttaaccgggaaccggtaacccggtaacccggtaaccggtacccggttacccgttaccccgggttcccgtacggttcccgttacccggtttcccggttaccccgttaccccgtaccccgttaccgtaccggttacggtaccggtaaggttacccgggcggttaccgggtcggtaccggg

SEQ ID NO: 101195 - DNA, 769 bp, Homo sapiens
  misc_feature: GYAE6OF02FJP6G.15.5.A05.1.454.CMB.1.raw
  modified_base (133)..(133): a, c, t, g, unknown or other
  misc_feature (133)..(133): n is a, c, g, or t
  modified_base (216)..(216): a, c, t, g, unknown or other
  misc_feature (216)..(216): n is a, c, g, or t
tcagtctacgtagccacgaccggtgctcgatttagatagatagacaggggtcccttccaatatcagcaccatggcctggactcctctctttctgttcctcctcacttgctgcccaggtccaattcccaggctntggtgactcaggagccctcactgactgtcgtccccaggtacggacacgtcactctcacctgtcggcctccagccacgtggacncctcgtccaccaatcggtaccacttactccccttacgtcggttacccaacagaacgccgtacgaccaccgccccgagacctacgtacgtacttacgtcgaactaaccaaaccaaccgtaaacctaccgttaccgtaccggtaccccgttccggtacccggtttcctaccgtaccggtcccgttccccggttacgggttaccgggggacctaacggtccgtaccgtacccgttaccggttacccggtttccggggtaccgccgtaccgaccggtaccgtacggacggtacgtacggtacgtacgtacgtacgttacgtacgtacgtccttcgcccttaccgtaccgttaaggttacggttcggtttcggttccggttacggttccgggtacggtaacggacctacgtcgtaccggtaccggttccgtacggtacaccgacccgtaacggtacccgtccgtccccgttcggtaccctaccgtacccgttcccgtccccgtaccccgtccgtcccgtaccgttacgtacggtacgccggacggtccggtacgtccg

SEQ ID NO: 101196 - DNA, 774 bp, Homo sapiens
  misc_feature: GYAE6OF02INQQM.15.5.A05.1.454.CMB.1.raw
  modified_base (202)..(202): a, c, t, g, unknown or other
  misc_feature (202)..(202): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcagggagccctcactgactgtcgtccccaggagggacagtcactctcacctgtcggctcngcatcggagctgtccacgatcgtctattactcctacgtggttaccaacgagacgcctggaccaacgaccccgaggacacgtgtattatgaataacaaactaaccaactactcgtaccggtaccctcggtcccggtactcgaccgtcctcccgttcgggttaccggggactaaacgcgtccgacccgtacgtaccgtacgtttacggtcgcgacgtacgtccgtacggtaaggtcgtagggacgtacgtacggtaaacgtttacggtttaactacgggttcttacggttcctaccgtttaacctaagtttacggggtttccgggtttggtttacgggggtttcggtttccggggaccgggttacggggtaaccgacggttacccgttacgggttaacccggtttaccggaacgggttaccaccgggttacccggaaccgggtcccgttacccgggtacccccggttccgggttaccttaacccgggttcccgtttacccccggtacccccggttcccgttacccgttccggaacctttacggtaccggtacggtaccggaccggtcggtcggg

SEQ ID NO: 101197 - DNA, 816 bp, Homo sapiens
  misc_feature: GYAE6OF02IDJ98.15.5.A05.1.454.CMB.1.raw
  modified_base (775)..(775): a, c, t, g, unknown or other
  misc_feature (775)..(775): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggacgccctcactgactgtcgtccccgaggagggacagtcactctcaccgtgtcggcctaccagcacgtggagctcgtaccacaatcggtacattacgtcctacgttcggtaccaacgaagaacgcctacggaccaaccggtccccgaggacacttgtaatttagtataactaacaaaaacaaccaaaccaccttaccgttaccggaaccccgtcggtaccccgttactaccggaccgtccctcccggttacgggttacgggggaacctaaacggtccgtccgccccggttacgtacccggttttacgggccgtacgtaccgacgtcccgtaggtaacggacgttacgggaggtaccgtagtaacgtttaacgttcgtcgtactttcggtaccttacgaccgtttaggttacggtttcgggttacggtttccggggttacgggttacccgggtacgggaaccggggtaaacctaacgggttacccgacgggtttaaccccggttacgttaccgggtaccgtaaccgggcccgtaacgggacccctccgggttacccccgtacgttccgtaacccgtttccggttaaccctaccccccggtcctttaaccccgccggttaacccggtttacnccgggttaccacgggggacgtaccgggttcgtaaaccgggg

SEQ ID NO: 101198 - DNA, 797 bp, Homo sapiens
  misc_feature: GYAE6OF02GC70Z.15.5.A05.1.454.CMB.1.raw
  modified_base (295)..(295): a, c, t, g, unknown or other
  misc_feature (295)..(295): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctcagcactggagctgtcaccaatcggtcattactccctactggttaccaaacacgaacgcctcggaccaacgccccctaaggaccacgtagaatttanagtaattaacaaaacaaacaaacaccgtacctaccgtaccccgtcgtcccggttctacgacggtaccttcccgtcgggttaggggaccaaagccgtcgtcccgtacgtaccgtttcgggacgtcgctacggcctaggacggtacgtacggacggtcgtacggtaactttacgttactacggtacttaggccttacgtaccgttagtacgggttacggggttcgggtttcggggtttacgttacggggtacccggggtaaagggtaacccgtaaacgggtccgttaacgggtaacccgggttaccgtttaaccgggtcccgtaaaccgggtaccccaaacggggttccccgttacccggtacccccccgtttacgggttacccgtacccgttttacccggttcccggtttacccccgtaccccgtttccccgtaaccggttacccgtttaacccggtaacgtacccggtttacggaaccgggttccgggtaccggtaacgggg

SEQ ID NO: 101199 - DNA, 790 bp, Homo sapiens
  misc_feature: GYAE6OF02H9J1Q.15.5.A05.1.454.CMB.1.raw
tcagtctacgtagccacgaccggtgctcgatttagatagatagacaggggtcccttccaatatcagcaccatggcctggactcctctctttctgttctcctcacttgctgcccagggtccaattcccaggctgtggtgactcaggagccctcactgactgtgtcccgaggagggacagtcactctcacctgtgctccagcacgtggagcctgtcaaccaagtggtctattaactccctacgttcggttaccaacagtaaacgccgtacggaccaaaccgcccccgaaggacctaaccgtgttaagttttactagtaaacttaaccaaaaaccaaacctaaaacacctttaccgtaccggaacccccgttcgtccccggttacctaccgtacggtcccgttacccggttcgggttccgggggaacgtaaacggtccgtccggtcccctacggttaccccgggttcgggtccgtacggactacggtccgtacggtaggtacggtgggaacggtcgtaggtaacgttacttaccgtcgttcggtctccttaccgtacgtttaggttacggttcgggttcgggttcgggttttacggtcggggacggttaagggaacctacggtccgtcggttaacccgttggttaaccgggtccgaaccgttacccggacggtcctacccgggtaccccgttcggacccgtactttcccgtacccgttttacccgccgtttcccgtaccgtccggttaaacccgtcgtaccggtaacgggtcggtaccggggtctaaccgggg

SEQ ID NO: 101200 - DNA, 717 bp, Homo sapiens
  misc_feature: GYAE6OF02JEZ8Y.15.5.A05.1.454.CMB.1.raw
  modified_base (206)..(206): a, c, t, g, unknown or other
  misc_feature (206)..(206): n is a, c, g, or t
tcagtctacgtagccacgaccggtgctcgatttagatagatagacagggtcccttccaatatcagcaccatggcctggactcctctctttctgttcctctcacttgctgcccagggtccaattcccaggctgtggtgactcaggacgccctcactgactgtgtccccaggaggacagtcactctcactgtggctccagcactgganctgtcaccaatggtcattactccctatggttccaactagaaacgcctggccaacgacccccaggacaactcgtaactttacgtgtactaaccaaaacaactaaactaacctcctacgaacccctcgtccggttctcgtacggtaccgtcccgttcggttacggggactaaacgccgtcgacccgtcgtaccgtttcgggttcggccgacgtacggccttacgggacggtacgtgggtaacggtacgtacgtaagttacgtttaacgtggtccttggtcctacgttcgttaacgtacggttggtacggtttcggggtttcgttccgggtacgggtacgggtacctaacgggtctaggtacccggttaccgtacgggtctaccggtacccgaaggtcccgtcccgtaccccgttaccggtccttaaccgttccgttccgttaaccccgcccttacccgtccgtaccgtaccggttaaccgtacgtacggtcgggtacccgggtaccgtacggg

SEQ ID NO: 101201 - DNA, 772 bp, Homo sapiens
  misc_feature: GYAE6OF02GHVCH.15.5.A05.1.454.CMB.1.raw
  modified_base (200)..(200): a, c, t, g, unknown or other
  misc_feature (200)..(200): n is a, c, g, or t
  modified_base (732)..(732): a, c, t, g, unknown or other
  misc_feature (732)..(732): n is a, c, g, or t
tcagtctacgtagccacgaccggtgctcgatttagatagatagacaggggtcccttccaatatcagcaccatggcctggacctcctctctttctgttcctcctcacttgctgcccaggtccaattcccaggctgtggtgactcgaggagccctcgactgactgtcgtaccccgaggagggacagtcactctcactgtgcncgagcacgtggagctcgtacaccaagtggtacacttactcccttacgtcggttaccaaacaggaacgccgtacggacctaacggccccgaagaccactagtacgtttatacgtaactaacaaaacaaacaaacctaccgtccgtaccggtaccccgtcgtcccggttacgtcgacggtccgttcccggtgggttacggggacaacgtccgtacggtcccttacggttacccggttcgggtaccgccggacgacggtaccgtagggacggtacggtaggtaccgggtacgtaggtttacgttaacgtttacgtcgtacgttccgtcttaccgttacttaggttaggtcggggttcgggtttacggggttcggtcggggtaacgggaccgggtaataacggtccggttaacggaccgttaccggtacggtaccggaccggttaacccggaacgggtcccgtacccgggttccccgtccggttaccctccgttcccggttccccgggttccccgtaccccgttcgacccgggttnttaacggggccgtacggtccggacgggttggccgtacggg

SEQ ID NO: 101202 - DNA, 892 bp, Homo sapiens
  misc_feature: GYAE6OF02FHKUR.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccaggtccaattcccaggctgtggtgactcaggacgccctcactgactgtcgtaccccaggacggacagtcactctctaccgtgtggtcctccacgcaccgtggacgtctcgtccaactaagtcggtactacttactccctacttccggtaccaacgacgtaactccgtcgaaccgaaccgccccgtagacctactgtaagtttataacgtactaaaccaaaacgtaaaccaacctaaccgtccgtaaccggtaccccgtaccggtacccggttcgtaccgtaccgggtcccttcccgggttaccggggttacggggaaccgtaaacggtccttacccggtacccggtacccgttacccgggtttcgggtacgtacccggtacgtaccggtacccggtaaggggtaccggtacggtacggtacgggttaccgtaacgggtttaaccgttttagtacccggtttaacggttcccggttaacgttccctttacccgtttacggtttaaacgggttaccggggttttcgggttttaaccgggggttttcccgggggttaccgggtttaaccgggggtaccccggggggttaaagggttaacccggtaaacggttcccgggttaaaccccgggtaccggtttaccgttacggtaaccggaacccggtacccgggtaacgtcccggttacccgtcccgttaccggtacttaccccgtacgttacccctaccccggtacccttccggaccgtcgtaccgtacgcggttacggtgccggtgtaccgg

SEQ ID NO: 101203 - DNA, 759 bp, Homo sapiens
  misc_feature: GYAE6OF02ILFKW.15.5.A05.1.454.CMB.1.raw
  modified_base (211)..(211): a, c, t, g, unknown or other
  misc_feature (211)..(211): n is a, c, g, or t
tcagtctacgtagccacgaccggtgctcgatttagatagatagacagggtcccttccaatatcagcaccatggcctggactcctctctttctgttcctcctcaccttgcttgcccagggtccaattcccaggctgtggtgactctaggacgccctacactgtactgtcgtcccaaggaggacagtcacgtctctactgtgctcagcactgntctgtcacctagtgtactattacctcctacgttcggttaccaagtacgtaacgccgtacggacctaaccgcccccgtaaggaacctacgttacggtactttacgactaacgtaaccgtaaaaaccgaaccaaaccgtaccgttaccgttaccggaaccccgttccggttacccgttcctacgtaacgtcccgttcccgttaacgggttccggggataaccgcgtccgttacccgtccggtttacggttccggcgttaccgacgtacgtaccgagtacggtagtccggagttcgtagtagttcgttacgtcgtacgtcgtacttaccgttacgttacggtacggttcgtttcgggtttcgggttcgggttaccgggacggtaaccgggtaaccgtaacgtcgtaccggttaccgtaccggtacgtacgaaccgtcccgtaacgtcccgtacccgtccgttccgccgtttaacccgtaccgttcccgtcccccggttacctacccgtccgtaaccgtaccgtcgtacgtcggtaccgggtccaccggacg

SEQ ID NO: 101204 - DNA, 607 bp, Homo sapiens
  misc_feature: GYAE6OF02IJ8UM.15.5.A05.1.454.CMB.1.raw
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
tcagtctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacaatggtcattactccctaactggtaccaacagaacgctggccaagccccaggaccactgattatgataacaaacaanaaacactctacggaccctgcccggttcncgacgcctccgtcggttacggggactaaagctcgccctgtacccttcgggcncgcacgccgtgacggatggacggctagtagtacttactcgtctgctctcctatacgtggtgttcggtgttcggcggtagaccgtagcgtacgtaccgtacgtcgtacgacgtccgaaggtccctacggtcccccgtacggtctacccgttcgttcccgttccccggtacccgttccctaccggttaccgttaacccggttcgtaccgtacggtacgggtccggtcggtaccggg

SEQ ID NO: 101205 - DNA, 871 bp, Homo sapiens
  misc_feature: GYAE6OF02HNTFA.15.5.A05.1.454.CMB.1.raw
tcagtctacgtagccacgaccggtgctcgatttagatagatagacaggggtcccttccaatatcagcaccatggcctggactcctctctttctgttcctcctcacttgctgcccagggtccaattcccaggctgtggtgactcagggagccctcactgactgtcgtaccccaggagggacaggtccacctctccacctggtcggctccagcactgggagtcctgtaccaacctaagttcgggtactaactttaccttaccctacgttcggttaccaaacgtaggaaccgtccgtacgggacccaaaccggcccccgtaaggtaaccacgtacggttaattttatacggtaaactaaaccgaaaaccaaaaccaaaccgtaccttaccccgtaccgggaacccccgttcggtcccccggtttccgtaccggacccgggtccccttcccgggttaccgggttaccgggggaactaacgtcggtaccggtccccgttacggtcccgggtttcggcggtccgcaccggtccgtagggacggtggtacggacgtcggtaacggcgtttatttacgcgttcctcggttaaccttccgttacgtaagttcggggtttagggttccgggtttcgggggtttccggttacggggaccggggttaacgtaaccggtaccgcggggttaacccggttaccggttacggtacgggaaccccgtacggaccgggtaaccctcggtaaccccgttcccccggtttagggacccctttaccgggttcccttaacccggtttccccccgtccccgtttaacggccccgttacggttaccggtaacggtccgggtaacggtcccggggtcgggttaccggacccgggg

SEQ ID NO: 101206 - DNA, 939 bp, Homo sapiens
  misc_feature: GYAE6OF02JTQ7D.15.5.A05.1.454.CMB.1.raw
tcagtctacgtagccacgaccggtgctcgatttagatagatagacaggggtcccttccaatatcagcaccatggcctggactcctctctttctgttcctcctcacttgtctgcccagggtccaattcccaggctgtggtgactcgaggtacgccctcactgactgtcgtccccaggagggacagtcactctcaccgtgtcggcctaccacgtcacgtgggacgtctcggtacaccctaagttcggtactacttaacctccccgttacgtcggttacccaaacgaacgacgccgtacggacccaaccggcccccgaagaaccgaccttaggtactttatacgaactaaccaaaaccaaaccaacgtacctacccgtacggaacccctcggtcccgttaccgctacggccctccggttccgggttacgggacgaaccgtccgtcggccccgttaccggttacccgttcgggttaccgccgtacgtacccggtcctaggggtaaacggtgtacggtcgggtaccgttaaggttaccttaagtttacccggtcgtcgtaacggttccttaacccgttcgttacgggttaacgggtttccggggtttacggggtttacgggttttaccccgggggttacggggtaacccggggggtaacgggtaaccccgtaaaggggtttcccgtaacccggggtttaccccggtaccgggtttaacccgggaccgggttaacgggtaacccccggttaacggttccccggttcccccgggtaaccccggtttcggggttacccctaacccgggttttccccgttaaaaccccggggtttcccccctttaccccggtaccccggttttaacccgtacggttaaaccccgggtttcgtacccggtaaccccgggggtttcgggtaaccccggggtttacggggtaaccccgggg

SEQ ID NO: 101207 - DNA, 407 bp, Homo sapiens
  misc_feature: GYAE6OF01EAETY.9.14.B03.1.454.CMB.1.raw
  modified_base (403)..(407): a, c, t, g, unknown or other
  misc_feature (403)..(407): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatcactgagcgggctggcaaggcgcatagnnnnn

SEQ ID NO: 101208 - DNA, 408 bp, Homo sapiens
  misc_feature: GYAE6OF01ERSL4.9.14.B03.1.454.CMB.1.raw
  modified_base (404)..(408): a, c, t, g, unknown or other
  misc_feature (404)..(408): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttcccagacgtatcactgagcgggctggcaaggcgcatagnnnnn

SEQ ID NO: 101209 - DNA, 406 bp, Homo sapiens
  misc_feature: GYAE6OF01D12EA.9.14.B03.1.454.CMB.1.raw
  modified_base (403)..(406): a, c, t, g, unknown or other
  misc_feature (403)..(406): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatcactgagcgggctggcaaggcgcatagnnnn

SEQ ID NO: 101210 - DNA, 410 bp, Homo sapiens
  misc_feature: GYAE6OF01BBSOI.9.14.B03.1.454.CMB.1.raw
  modified_base (399)..(399): a, c, t, g, unknown or other
  misc_feature (399)..(399): n is a, c, g, or t
  modified_base (405)..(410): a, c, t, g, unknown or other
  misc_feature (405)..(410): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggccgccctgctccaggacgcacctccgagagcacagcggccctgggctgcctggtcaaggactacttccagacgtatcactgagcgggctggcaaggcncatagnnnnnn

SEQ ID NO: 101211 - DNA, 467 bp, Homo sapiens
  misc_feature: GYAE6OF01DZ1IH.9.14.B03.1.454.CMB.1.raw
  modified_base (441)..(467): a, c, t, g, unknown or other
  misc_feature (441)..(467): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagactcactgactttgcaaatgaacaccctgcgagccgaggacacggccgtatattactgtgcgaagaataacccgttcgcctggtttattaccttgacacgttgggggccagggaaccctggtccaccgtctcctcagcctccaccaagggcccatccggttcttcccctggccgccctcgcctccaggacgccacctcgagagccacacgccggccctgggctcggacctggtaccaaggacctacgttcccagacgtactcactggacggccgggctacgggacaacgggcgcaagtaggcagnnnnnnnnnnnnnnnnnnnnnnnnnnn

SEQ ID NO: 101212 - DNA, 406 bp, Homo sapiens
  misc_feature: GYAE6OF02FWV54.9.14.B03.1.454.CMB.1.raw
  modified_base (404)..(406): a, c, t, g, unknown or other
  misc_feature (404)..(406): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagtggccctgggctgcctggtcaaggactacttccagacgtatcactgagcgggctggcaaggcgcatagnnn

SEQ ID NO: 101213 - DNA, 528 bp, Homo sapiens
  misc_feature: GYAE6OF01BE5ZC.38.3.A03.1.454.CMB.1.raw
  modified_base (344)..(344): a, c, t, g, unknown or other
  misc_feature (344)..(344): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaatcataatttatgacgtcagtagtcggccctcaggggtttctgatcgcttctcaggctcaagtctggcaacncggcctccctgaccatcctctgggcctccgaggttgaggacgaggctgacttattattgcgcctcacatggaatcgagggtagggttttcggcgggagggaccaagtcgaccgtcgtaggtcagcccaaggccgtcgcccccgtggtccactccgtcgttccccacccttccctctcgtgtacg

SEQ ID NO: 101214 - DNA, 794 bp, Homo sapiens
  misc_feature: GYAE6OF01CZXLV.38.3.A03.1.454.CMB.1.raw
tcagtcgatcacgtcacgaccggtgctcgatttagagagcgtcacagggggcaagcgccctcaggacatcctccaccatggcctgggctctgctgctcctcacctcctcactcagggcacgagggtcctgggacccaatctgccctgactcacgcctgcctccgtgtctgggtctccgtggacaggtcggtcgcctatccgtcctgcacgtggaaccagcaagtgactagttggtaactttactaaccattcgttctccgttacggtaaccaacgactaccaacccaagaaccaaccggacccccaaaactctaattaaagtttatacggacgtactaaggtacgtccggaccgttacggtaaggggtttcctagtacgttccgtcctttacgtacgtacggtacctaccgtaaaggtcctacgggacctaaaccggacccggtccctacccgtacgaccctaacgtccgttcgtacgggtccttaccggtacgggttacggaacggtaaccgggacggtaccgtaagggttaacctttaacgtttacggttccggtacccgttaccgtaccgtaaccgtaagttacgggtaaaccgtacgggttaacggggttaacggggttttccgggggaacggtaaccggggtaaccgtaaacgggtaccgtaccggttaccggagtaccgaacggtaccggaacggtaccgtccggtaccccgtcgttacgtaacccgttccgttacccggttacccccgtcccgttacccgtacgtaacccggttgtaccgttaccgg

SEQ ID NO: 101215 - DNA, 533 bp, Homo sapiens
  misc_feature: GYAE6OF01CJDUK.38.3.A03.1.454.CMB.1.raw
  modified_base (347)..(347): a, c, t, g, unknown or other
  misc_feature (347)..(347): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcataatttatgacgtcagtagtcggccctgaggggtttctgactcgcttctcaggctccaagtctggcaacncggcctcctgaccatctcgtggctccgaggttgaggacgaggctgactattattgcgtcctcacatggaatcgagggtagggtttcggacggagggtaaccaaaggtcgaccgtccgtaaggtcacgcccgaaggcctcgcccccgtcggtccacgtcctcgttccccgccctcctcacgtgtacg

SEQ ID NO: 101216 - DNA, 518 bp, Homo sapiens
  misc_feature: GYAE6OF01DMVE9.38.3.A03.1.454.CMB.1.raw
  modified_base (208)..(208): a, c, t, g, unknown or other
  misc_feature (208)..(208): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccngcagtgacattggtacttataaccatgtctcctggtaccaacatcacccagacaaggcccccaaatcataatttatgacgtcagtagtcggccctcaggggtttctgatcgcttctcaggctccaagtctggcaacacggcctccctgaccatctctggctccaggttgaggacgaggctgactattatgcgcctcacatgaatcgaggtagggttttcggacggagggaccaagtcgaaccgtcgtaggtcacgcccgaaggctcgccccctcggtcaccgtctcgttcccgccctccncncgtgtacg

SEQ ID NO: 101217 - DNA, 573 bp, Homo sapiens
  misc_feature: GYAE6OF01BUDBF.38.3.A03.1.454.CMB.1.raw
  modified_base (285)..(285): a, c, t, g, unknown or other
  misc_feature (285)..(285): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggcccccaaactcataatttangacgtcagtagtcggccctcgaggggtttctgatcgcttctcaggctaccaagtctggacaacgacggcctccctgaccatctctcgggctccgaggttgacggacgaggctgactattatgcgtcctcacatggtaatcgagggtagggttttcgggacgggtacgggaaccgtaaaggtcgacccggtaccgtacgggtcaacggcccgaacggccgtccggtccccccgttacgggtccaccgtccttccggttccccgtccccttccctccgaccgtcgtaccg

SEQ ID NO: 101218 - DNA, 613 bp, Homo sapiens
  misc_feature: GYAE6OF01D7ATU.38.3.A03.1.454.CMB.1.raw
  modified_base (179)..(179): a, c, t, g, unknown or other
  misc_feature (179)..(179): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacngtcggtcgccatctcctgcactggaaccagcagtgactattggtacttataaccattgtctcctggtaccaacatccaccagacaacgacccccaaactcaattaattatgacgtcagtacgtccggccctcgacgggtttctgatcgtcttctcacggctccaagtctgacaacgaccggcctcctcgacctatctcgtcggctcgtaggttcgaggcgacggtctagacttagttacgtcgccgtcctctacagtaggtaactcggtagggtacgggttttcggacgggtacgtacggtaaccgtaaaggtaccggtaccggtccgtaacggtaccaccggacccgacgggtccctaccggtcccccttccgggtacctacccgttccgttcccgttaccccctaccccttcccttccgtaccggttaccgg

SEQ ID NO: 101219 - DNA, 543 bp, Homo sapiens
  misc_feature: GYAE6OF01BQH7D.38.3.A03.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaactcataatttattacgtcagtagtcggccctcgaggggtttctgatcgcttcncagctcaagtctggacaacncggcctccctgacctatctcgtgggcctccgaggttgacggacgaggcttagactattattcggcgtcctcacagttggaactcgaagggtgggtttcgggacggagggaccaaggtcgacccgtcgtacggcacgaccgtaggcctcgccccgtggtcactcctcggttccccgtcccttctacncgtgngtccg

SEQ ID NO: 101220 - DNA, 527 bp, Homo sapiens
  misc_feature: GYAE6OF01A6RLB.38.3.A03.1.454.CMB.1.raw
  modified_base (519)..(519): a, c, t, g, unknown or other
  misc_feature (519)..(519): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaactcataatttatgacgtcagtagtcggccctcaggggtttctgatcgcttctcaggctccaagtctggcaacacggcctccctgaccatctctgggctccgaggttgaggacgaggctgactattatgcgcctcacatggaatcgaggtagggttttcggcgggtagggaccgaaagtcgaccgtcgtaggtcacgcccgaaggccgtcgcccctcggtccacgtcctcgttccccaccctcctcncgtgtacg

SEQ ID NO: 101221 - DNA, 684 bp, Homo sapiens
  misc_feature: GYAE6OF01B57S5.38.3.A03.1.454.CMB.1.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagaccaacggcccccaaatcaataatttangacgtcagtagtcggccctgagggtttcngatcgcttctcaggctccaagtctggacaaccgaccggcctcccgtagaccctatccgtcgtcgggtcctaccgtagggttcggacgggacggaggtccgtacgtaacttagttaacttcggaccgtccctacgaaccgtaagtacgggtaacgtcggtaaggggttacggggttttaccggggacggggtaacggggtaaacccgtaaaggttccgggtaacccggttaccgttaacgggtccgaaccggtaccccgaaacgggtcccgttaccccgggtcccccgttacccgggttcctaccccgttccgtttacccggttaccccctacccccgtttaccctcccgtaaccggttcggtaacccg

SEQ ID NO: 101222 - DNA, 619 bp, Homo sapiens
  misc_feature: GYAE6OF01CLEIL.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggaccccaaactccataatttatgacgtcagtagtcgcctcagggtttctgatcgcttctcagctcaagtctgcaacacgcctccctgacactctctcgggctccagggttagacggacgaggctgacttattagttacgccggtcctacacgtagtacggaattccgaagggttcgggttttacggggcgggaacggggtaccgtaaaacggtcgggtaacccgtccgttaacgggtacaaccggaccccgtaaacgggaccttcccgggccccccgttacccgggtcctaacccgttccgttaccggtttccccccaaccccgttccccgtacccgtacggttccgtaaaccgg

SEQ ID NO: 101223 - DNA, 613 bp, Homo sapiens
  misc_feature: GYAE6OF01D191F.38.3.A03.1.454.CMB.1.raw
  modified_base (181)..(181): a, c, t, g, unknown or other
  misc_feature (181)..(181): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctgccctgactcagcctgcctccgtgtctgggtctccgtggacngtcggtcgccatctcctgcactggaaccagcagtgactattggtacttanaaccntcgtctcctaggtaccaacactcaccagacaacggaccccaaactcaattaatttatgacgtcagtacgtccgccctcgagggtttcngtactcgtctcgtcacggtctaccaagtcgtaggacaacgaccggcctcctcgaccctatctcgtcggtcctcgaggttgaggacggaggtctagtactattagtcgcgtctcactagtacgtaagtcgagggttacgggtttcgggacggtaacgggaactaaacggtcggtaacccgtaccgtaacggtaccgacgtacccgtaagggtcctcccggtaccccgttacggtcccgaccttccgtcccgttacccctaccccttacctaccgtaccgtcggtaacccg

SEQ ID NO: 101224 - DNA, 554 bp, Homo sapiens
  misc_feature: GYAE6OF01BOT8Z.38.3.A03.1.454.CMB.1.raw
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcataatttatgacgtcagtagtcggccctgtaggggtttcngatcgcttctcaggctcaagtctggcaacgacggcctccctgaccatctcgtgggcctccgaggttgaggacgagctgactattatgcncctcacatgatcgaggtgggtttcggacggacgggtacctaaaggtcgaccgtcgtaggtacacgacccgaaggcctaccggtcccccgttacgggtcctaccgtccgttccgttacccccgcccgttaccctccgtacggttgtaccg

SEQ ID NO: 101225 - DNA, 556 bp, Homo sapiens
  misc_feature: GYAE6OF01EGDGU.38.3.A03.1.454.CMB.1.raw
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatctcctgcactggaagcagtagtgactagttgggtagttaataaactatgtctcctggtaaccaacaacacccaggaccaaacgacccccaaactcaatctatttatgacgtcactcatcggccctcgagggtttctactcncttctctggctcagttgcaacacggcctccctnacctatttcgtggctccaggctgaggacgaggctagtaattttagtgtctcctcatactacgaggcagcactcctacccttatcgttcgttacggaacgtacgggaaccgaacggtccacccgtacctacgtcacgacccgaacggaccctaaccccacgtcgtaccaccttcctcgttccccaacccccg

SEQ ID NO: 101226 - DNA, 514 bp, Homo sapiens
  misc_feature: GYAE6OF01B13CT.38.3.A03.1.454.CMB.1.raw
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
  modified_base (497)..(497): a, c, t, g, unknown or other
  misc_feature (497)..(497): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcataattntgacgtnagtagtcggccctcgagggtttcngactcgcttctcaggctcaagtctggacaacgacggcctccctgaccatctcgtggcctcgaggttgagacgagctgactattatgctctcantagatcgtaggtagggtttcggcggagggtacaagtcgacgtctaggtcagccgaaggcgtcgccccgtcggtcacgttctccgtccccnccctcctctcgtgtacg

SEQ ID NO: 101227 - DNA, 689 bp, Homo sapiens
  misc_feature: GYAE6OF01DFXGF.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctcgtgtctgggtctcctggacagtcggtcgccatctcctgcactggaaccagcagtgacattggtacttataaccatgtctcctggtacaacatccaccagacaacgacccccaaatcataatttatgacgtcagtacgtccgccctcgtaggggtttctgatcgcttctcgacggctaccgaagttctacggacaaaccgaccggtccctacccgtcgaaccctatccgttccgtcgggtacctacccggtaagggttcggaacgggacggtacgggtccgttagtaacctttaagttttaacgtttcggacccgttaccctacgaaccgtagttacgggaaacttaccggtaagggggtttacggggttttcggggaaccggggtaaccggggtaaccgtaaacgggtcggtaacccgttacggtaacgggtccgaaccggaccccgaagggtcccgtccggtaccccccgttcgggtaccctaccgttccgtcccgttccccgaccccttccctcgaccgttcgtaaccg

SEQ ID NO: 101228 - DNA, 692 bp, Homo sapiens
  misc_feature: GYAE6OF01BZO5L.38.3.A03.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttanaaccatgtctctgtaccaacatcaccagacaacggcccccaaactcaataattatgacgtcagtagtcggcctcgagggtttcngactcgcttctcacggtctccgaagtcgtggacaacgcggtccctcctgacctactccgtcgtcgggtcctaccgaggtttcggaacgggtacgaacgggtctaggtaacttaagtttacgttcgacccgtacctacgtaacgtagttaggaacgttacggtaaggggttacggggttttaccgggacggggtaacggggaacccgtaaagggttccggaacccggttaccgtaacgggtccgtaaccgggaccccggtaaacgggtcccgttacccggtccccccgttaccggggtcccttaacccgtttcccggtttaccccgggtttccccccgaccccgtttaccccgttacccgttaccgggttccgtaacccgg

SEQ ID NO: 101229 - DNA, 685 bp, Homo sapiens
  misc_feature: GYAE6OF01C9Z5S.38.3.A03.1.454.CMB.1.raw
  modified_base (193)..(193): a, c, t, g, unknown or other
  misc_feature (193)..(193): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcgtcgccatccncctgcactaggaaccagcagtgactattggtacttataccatgtctcctaggtaccaacactccacccagaccaacggaccccctaaactactaattaatttactagaccgttcgacggtacgtccgggtccctcgggtagggttttcacgtacttccgtctttcgtccgacggtccctaccgtacggttcgtacggacctaaaccgtcccggtccctacccgtacacctacgttcctcggtcgggtacctaccggtaggttacgggacggacggtacggtcgtaacgtacttagttactcgtccgtacctacgacgtacggtagtaacgtcgggtacgggttcgggtttaccgggagggtacggaacgtaacggtcgtaccggtacgtacgaccgaccggacccgaacggttccgtcccgtccccgttaccggtcctaccgttcccgttccccgttacccctacccttacccgtccgtacgtcgtaaccgg

SEQ ID NO: 101230 - DNA, 802 bp, Homo sapiens
  misc_feature: GYAE6OF01AL8EC.38.3.A03.1.454.CMB.1.raw
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
tcagtcgatcacgtcacgaccggtgctcgatttagagagcgtcacaggggcgagcgctctcaggacatctccaccatggcctgggctctgctgctcctcaccctcctcactcagggcacagggtcctgggcccaatctcgccctgactcagcctncctccgtgtctgggtctcctggacngtcggtcgccatctccngacnctggaaccgcagtgaccnttggtacttanaaccatgtctcctggtaccaanactcaccagacaacggcccccaaactcaataactttactcgacgtctagtacggtccggtacctccgtaggggttttccacggtacttccggtcctttccgtaccgtacggtcccttaccggtaaacgttccgtccgggtactaaaccgtacccgggtcccttacccgttaccggacccttaacgttcgtcccggttacgggggtcccttaccccgggtaagggtttacggaaccggggttacggaacggggttccctttaaacggtaccggtttaacgtttttaaccggtaccggttcccggttaaccctaccggttaacctacgggtttaaacggtaaacggtccccggtttaaggggtttaccgggggtttttaccgggaaccggggtttaacggggtaaacccgtaaacgggtacggttacccggttacgtaacgggttacaccgggtacccgtaagggtacccgtcccggtcccccgttacgggtcctaacccggttccttcccgtccccgtaaccccgtccctacggttaacggaccttccggg

SEQ ID NO: 101231 - DNA, 577 bp, Homo sapiens
  misc_feature: GYAE6OF01E3LL8.38.3.A03.1.454.CMB.1.raw
  modified_base (287)..(287): a, c, t, g, unknown or other
  misc_feature (287)..(287): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaactcaataatttangacgtcagtacgtccggccctcgtagggtttctgatcgtcttctcaggctccaagtctggcaacgacggccctcctcgaccatctcgtggcctccgtaggttgaggacgaggctgactagttattcgcgtcctcacatggaactcgagggtagggttttcggcgggagggaccgtaaacggtcgacccgtaccgtacggtacgacggacccgaacggtaccgtccggccccccgttacggtccctaccgtccgttccgttccccgccccttacctccgacgttcgtaccg

SEQ ID NO: 101232 - DNA, 631 bp, Homo sapiens
  misc_feature: GYAE6OF01CRCZJ.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatccacccagacaacggacccccaaactcataatttatagacgtcagtagtccggccctgagggtttctgtatcgtcttctcacggtctccaagtctggcaacgacggcctccctgaccatcctcgtggcctccgtaggtgaggacgaggctgacttagttagttcgcgtcctcgactagttaggtaagtttaagggtacggggttttcgggaccgggtaacgggtaaaccgtaaagggttccggtaacccggttaccgtacggtaccgacggaccccgaaacgggtcccgtaccggtcccccccggtaggttccctaccgttccgttcccggtttccccccgtccccttccccgtaccgtaccggtgtacgttaccccgg

SEQ ID NO: 101233 - DNA, 521 bp, Homo sapiens
  misc_feature: GYAE6OF01EBHFN.38.3.A03.1.454.CMB.1.raw
  modified_base (287)..(287): a, c, t, g, unknown or other
  misc_feature (287)..(287): n is a, c, g, or t
  modified_base (408)..(408): a, c, t, g, unknown or other
  misc_feature (408)..(408): n is a, c, g, or t
  modified_base (516)..(516): a, c, t, g, unknown or other
  misc_feature (516)..(516): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaaactcattaatttangacgtcagtagtcggccctcgaggggttttctgatcgcttctcaggctccaagtctggcaacacggcctccctgaccatctctgggctccgaggttgaggacgaggctgactattattgcncctcacatgaatcgagggtagggttttcggcgggaggaccaaagtcgaccgtctaggtcacgccaaggcgtcgccccctcggtccactctcgttcctcaccctcctcncgtcg

SEQ ID NO: 101234 - DNA, 807 bp, Homo sapiens
  misc_feature: GYAE6OF01CGPK5.38.3.A03.1.454.CMB.1.raw
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctgccctgactcagcctgcctcgtgtctgggtctccgtggacnggtcggtcgccatcctcctgcacgtggaaccagcagtnactattggtacttanaaccntcgtctcctggtaccaacatcaaccagacaacggaccccaacnctattaacttatgacgtcagtacgtccgccttgtagggtttctgtatccgtcttcctacgacggtcctaccgaacgtcctcggactaaaccgaccgggtccccttcccgacgaacctcgttcctcgtcgggtaccctccgtagggttcggacgggtaacgacggtcgtacgtacgttaagtttacgttacgggtccgtacccttacgtaaccgtacggttaacgggaaacgtttacccgggtaagggggtttaacggggggtttttacccggggaacggggggttaaacccggggtaaacccggttaaaaaacgggttcccgggtaaaccccggtttacccgggttaacgggttacccgtaacccgggaccccggtaaaaccggggtccccggtttaccccgggtacccccccggtttacccgggttcccgtaaacccccggtttcccgggtttaccccggtttaccccccccggtaccccgtttcccccggttaaccccgtacccgggtttcgtaaacccccggg

SEQ ID NO: 101235 - DNA, 740 bp, Homo sapiens
  misc_feature: GYAE6OF01CPQM2.38.3.A03.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctcgccctgactcagcctcgcctcgtgtctgggtctccgtggacagtcggtcnccatctctgcacgtaggaaccnggcaagtgacctagttcggtaacttaactaaccgattcggtccttccgtacggtaaccctaaacactaccaacccgaacggaaccaaacccggaacccccaaaacttacctaaatttaaaactttaacgtacggtaaccgttacgtaacggttaacggtccggtacccgttacggtaacggggttttctacggtactccggtctttaccgtacgtacggaccttaccgtaagttcgtacggacctaaacccgccggtacccttacccgtacgaaccctacgttccgtcggtcgggtccgtaccggtaagggttacggaacgggtacggacggtacttacggtaacctttagttacgtcgccgtacctacgacgtagtacggagttacgggagggttacgggttcgggacggtaacggaacgtaacggtcgtaaccgtcgtaacgggtacaccggaccgaggtccgtcccgtacccgtcggtcctaccgttccttcccggtccccgtaccctaccgtcgcgttacgtcg

SEQ ID NO: 101236 - DNA, 852 bp, Homo sapiens
  misc_feature: GYAE6OF01DSSVT.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctgccctgactcagcctgcctccgtgtcgtgggtctccgtggacaggtcggtcgcctattcctcctgcacgtacggaaccagcgtagtgactagttcggtacttactaacctagttcgtaccttccgtacggtaacccaaactactacccaacccacggaaccgaaacccggacccccctaaaactacctaaatttaaacttttaacgtacggtaaccgttacggtaacggttaaccggttcccgggtaaccccgttacgggttaacgggggtttttcccaaggttaaccgttcccggttaccgtttaccgtaccggttaaccggggtaccccttaaacccggtaaaacggttcccggttaacggggaacccctaaaaccccgggtacccccggggttacccccttccccggttaaaccgaaaccccgtttaacgttacccggttacccgggttccgggtacccgttaccgggttaacgggtttacggaacgggtacggtacggtacgtaacgtacttaacgtttagttaccgccgtaccgtaccgtacgtacgtacggtaacgttacgggtacgggttacggggtttaccgggacgggtaacggtaaaccggtaacggtacggtacccgtacgtacggacgaccgaccggacggccgtcccgtcccgcgtcctaccgtcccgttccgtcccctccctcctccgtcgtgtaccgg

SEQ ID NO: 101237 - DNA, 596 bp, Homo sapiens
  misc_feature: GYAE6OF01CNRG4.38.3.A03.1.454.CMB.1.raw
  modified_base (288)..(288): a, c, t, g, unknown or other
  misc_feature (288)..(288): n is a, c, g, or t
  modified_base (430)..(430): a, c, t, g, unknown or other
  misc_feature (430)..(430): n is a, c, g, or t
  modified_base (571)..(571): a, c, t, g, unknown or other
  misc_feature (571)..(571): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattcggtacttataaccatgtctcctggtaaccaacatcaccagacaacgacccccaaactcaataatttancgacgtcagtagtccgacctgtagggtttctgatcgcttctcacggctccgaagttctggacaacgacgccctcctgacctatcctacgtcgggtcctaccgtaggttgacggacgaggctgacttagtattgccgtctcanagtacggaatcgtagggttacgggtttcggacgggtaacgggaccgtaaaggtcgtaacccgttcgtaacggtccgaacggcccgtaagggcccgtcccggcccccgttaggtaccctccgttccgttcccggttaccccnccccttcgtccctcggtcgtacccg

SEQ ID NO: 101238 - DNA, 632 bp, Homo sapiens
  misc_feature: GYAE6OF01EJ1XX.38.3.A03.1.454.CMB.1.raw
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactattggtacttataaccatgtctctggtaccaacatcaccagacaacggcccccaaactcaataatttangacgtcagtacgtcggccctcgagggtttcngatcgcttctcgaggctcaagtctggcaacaccggcctcctcgaccatctcgtcggctcgaggttgaggacgagtctagacttagttattcgccgtcctacactagtggaactgtaggggtacggggttttacgggacgggtaaggggtaaccgtaaagggttacggtacccggttaccgttacgggtaccgaaccggtaccccggaaaggtcccgtcccggtccccccggttaccgggttcccgtaacccgtttcccgttccccggtttaccccccgtccccttaccccgttccgtaccggtcggttaacccgg

SEQ ID NO: 101239 - DNA, 668 bp, Homo sapiens
  misc_feature: GYAE6OF01EAAVL.38.3.A03.1.454.CMB.1.raw
  modified_base (282)..(282): a, c, t, g, unknown or other
  misc_feature (282)..(282): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacgccccaaactcataattangacgtcagtagtcgcctgacgggtttctgatcgtcttctcaggcctctaacgtctggacaaccgaccggtccctcccgtacgaccctatccgttacgtcgggtcctcccgtagggtttacgaacggggtacgacgggtcgtagtaacgttacgtttagttcgtccgtccctacctactacgtacggtaagtacgtaaggggttacggggttttccgggacgggaacggggtaacccgtaaaggtccggaacccggttaccgttacgggtaccgtaccggaccccgtaaacgggcccgtaccggtccccccggttacgggtcccctaaccgttcccgttacccggttcccccgtcccccttcccgttcccgtaccgtcggtaacccg

SEQ ID NO: 101240 - DNA, 644 bp, Homo sapiens
  misc_feature: GYAE6OF01EUXP9.38.3.A03.1.454.CMB.1.raw
  modified_base (307)..(307): a, c, t, g, unknown or other
  misc_feature (307)..(307): n is a, c, g, or t
  modified_base (405)..(405): a, c, t, g, unknown or other
  misc_feature (405)..(405): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcacgtggaaccagcagtgactattcggtaacttaactaacctatcgttcctccgtacgtaaccaaacactccaacccaagaaccaaccgaccccaaactcaattaatttntagtacgtacgagtacgtcccggcctcgtagggtttctgtactcgtcttctcgaggtcctacgagtcgtcgacaaccgtccgtccctcctcgaacctntcgtcgtcggctccgtaggttacggacgggacggtagtctacgtacttattacgtcgtccgtcctacacgtagtacggtaacgtcgggtagggtacgggtttacgggacgggtaacgggtaacgtaacggtcgtaccggttaccgtacggtacgaccgtacccggaagcccgtccgtaccccgttcgtccgtaccgttccgttccccgttcccgcccttacccgtccgtcgtcgtacgg

SEQ ID NO: 101241 - DNA, 731 bp, Homo sapiens
  misc_feature: GYAE6OF01BMHVT.38.3.A03.1.454.CMB.1.raw
  modified_base (215)..(215): a, c, t, g, unknown or other
  misc_feature (215)..(215): n is a, c, g, or t
  modified_base (719)..(719): a, c, t, g, unknown or other
  misc_feature (719)..(719): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctcgccctgactcagcctgcctccgtgtctgggtctccgtggactggtcggtcgccatctccgtgcacgtcggaaccngcagtgactagttcggtaacttataacctatcgtccttcctacggtaaccaaactactaccaacccaagaaaccaacccggaacccccctaaaacttctaaatttaaactttacgtacggaaccgtacgtaacgtacggtcccggtacccgttcggttaacggggtttctagtaccgttcgtccttacgtacgtacggtcctaccgtaaacgtcgtaacggacctaaccggaccggtccctaccgtcgaacctcttccgtacgtccgggtactaccggtagggttacggaacgggtacgtacggtcttacggtaatttacgtttacgttccggaccgttcctacgtacgtaggtacgtacgtacgggtagggttcggggtttacggacgggtaacggtaacgtaacggtcgtaaccgtaccggtgtaccaccggaccgtaacggtcccgtcccggtccccgtacggtcctaccgttccttccccgtaccctccctacgttaccncggtcgtaaccg

SEQ ID NO: 101242 - DNA, 697 bp, Homo sapiens
  misc_feature: GYAE6OF01A4L2W.38.3.A03.1.454.CMB.1.raw
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
  modified_base (435)..(435): a, c, t, g, unknown or other
  misc_feature (435)..(435): n is a, c, g, or t
  modified_base (487)..(487): a, c, t, g, unknown or other
  misc_feature (487)..(487): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctcgggcccaatctcgccctgactcacgcctcgcctccgtgtcgtcgggtcctccgtggactacggtcggtccgcctactcctcctgccacgtcggaaccagcagtnactagttacggtactagtaacctatcgtcctcgtacgtaaccaacactccaccgacgaaccgaaccgacccctaactctaattaactttacgtacgacgtcgtaacgtaccggtccggtacctcggttacgggtttctgtacgtcgtacttcncgacggtacctacgtaacgtcgtacgaccgaaccgtaccgtccctaccncgtaacctcggtacctcggtcggtcctacgtagggtcgacgggacgacggtntacgtacttatcgttcgccgtctacgactacgtacgtaacgtcgggtagggttcgggttacgggaacgggtacggtaacgtaacggtacgtacccgggtacgtaaccgggtccgtaccgaaccgtacggtcccgtcccgtccccggttaccgtccgtacccgtcccggttcccgtaccccgtcccgtacccgtcgtaccgtggtaacccg

SEQ ID NO: 101243 - DNA, 985 bp, Homo sapiens
  misc_feature: GYAE6OF01BJV1P.38.3.A03.1.454.CMB.1.raw
  modified_base (177)..(177): a, c, t, g, unknown or other
  misc_feature (177)..(177): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctcgtgtctggtctcctggacngtcggtcgcctatctcctgctacgtacggaacctgcagtgactagtttcggtaacttaactaacctagttcgtccgttaccgttacgggtaaacccaacctaacgttacccaacccccgtaaacggaaccgaaacccgggaacccccccctaaaacgttacctaaactttaaaacgttttagtaccggtaacccggttacgtaacgggttaaccggttccccgggtaccccgtttacgggttaccggggggttttttcctaacgggttaacgttacccgttaccgttttacccgttaaccgtacgggttaccccgttaacccgtaaacgggttcccggttaccgggaccctaaaaccccgggtacccgggttaacccccgttaccccgttaccggtaaaccccttacgttacccgtttacccgggttccggggttaaccccttacccgggttaacggggtttacgggaaaccgggggtaacccgggtaacggggttaccccgttaacggtaaccgttttaagttttacggtaccggtcccggttaccctacgtaaacgacggtttaacggtaacgttaccgggtaacgggggtttaaccgggggttttaccggggaacgggggtaccggtaaccgggttaaacggttaccgggacccggttacggtaccgggtacgtaacccggggaccctaaaccgggttcccgtacccgggtaccccccggttaggttacccctaccggtttaccccgttcccgggttaccccccacccccgtttaccgtcccgtaacccggttcggtaaccccgg

SEQ ID NO: 101244 - DNA, 758 bp, Homo sapiens
  misc_feature: GYAE6OF01CZ4CD.38.3.A03.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (750)..(750): a, c, t, g, unknown or other
  misc_feature (750)..(750): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctcgccctgactcagcctgcctccgtgtcgtcgggtctccgtaggactacggtccggtcncctatccgtcctgcacgtacggaaccaggacgagtcgaactatttacggtaacttaanaaccattcgtctaccgtggtaaccaacactaccaacccgacgaaaccaaccggaaccccctaaaactactaaatttaaatttacgtacgtacgtacgaaggttaaccggtcccggtacccgttacggttacggggtttactcggtaacgttccggtactttaccgcgtaacgccttaacgtaacgtcgtacggaacctaaacggcccgtcctacccgtactaacgtactacgtttcggacggtccgtaccggaggttacggaagggtacggtaggtacttaacgtaacttagttacgtacggtccctcctacgaactcggtacgtaacgtcgggtacggggttaacgggtttacgggacgggtaacggtaaccgaaacggttcgggtaaccgttcggtaacggaccgtaaccggaccgtaaccgtccggaacccgtcccgttaccgggccttaacctccggttccctaccccgggttcctaccggtacctacggngttacccg

SEQ ID NO: 101245 - DNA, 950 bp, Homo sapiens
  misc_feature: GYAE6OF01DW35P.38.3.A03.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
tcagtcgatcacgtcacgaccggtgctcgatttagagagcgtcacgagggggcagcgctctcaggacatctccaccatggcctggctctgctgctcctcaccctcctcactcagggcacgacgggtcctcggcccaatctcgccctgactcgacgcctgcctcgtgtctggtctcgtggactagtcggtcncctactccgtcctgcctacgtacggaaaccnggaccaggttacaacgttagtttacggtaaccttaacgtaaacctgttcgttcctaccgttacggtaaccaaactactaccgaaaccgaacgaaaccaaacccggaaccccctaaaacttactaaacttttaaactttacgtacgtaaccgttaacgtacggttaaccggtcccgtaccgttacgggtacgggtttttactacggtacgttacccgttcgtttaccgtacggtaacggtacccgtttaaccgtaaacggtttccggttaacggaccccgtaaacccggaaccccgggttcccctttaacccgtaccggtaaccttaaccgtttcccggttacggtttccggggtacctttaacccgggtaagggtttaacgggaacgggtaaccggttacgggtaaccgtttaacggtaacgtttaacgtttttaacggtcccggtaacccggttaccttaaacccgtaaacgttaagttaaacgggggttaacgttaaccgggtttaacggggggtttaccgggggttttaaccgggaaaccggggtaaaccggggtaaacgtaaccgggtttaccggtaaccggttaccgtacgggtaaacccgaccggtaaacccgggtaacggttccccggtacccggttccccgtacggttaacccttacccgggttcccgttaccccgttaccccctacccgttaccttaaccgggcgttacggtaacccgg

SEQ ID NO: 101246 - DNA, 707 bp, Homo sapiens
  misc_feature: GYAE6OF01B4PH4.38.3.A03.1.454.CMB.1.raw
  modified_base (211)..(211): a, c, t, g, unknown or other
  misc_feature (211)..(211): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggcagtccggtcgccatcctccctgccactggaaccngcagtgactattggtacttataaccattcgtctccgtacggtaaccaactactccaacccgagaccaaccggacccccaaactcctattaactttatcggtaccgtcgtagtacggtccggtaccctcggtacggggtttctaggtacttcgtcttccgtcgacgtcctaccgaagttcgtacgtcaaccgtccgtccctaccgtcgacctacgtccgtacggtcgggtcctcggtagggttacgacgggtacgtcggtactagtacttaagtttcgtcgaccgttaccacgtacgtagtacggaacgttcgggtaagggtttaccggggtttacgggccggggtaacgggtaaccgtaaacggtcggtaacccggttccggtaagggtacccgaaccggtacccggaaccggtccttacccggggtaccccttcgggtaccttacccggtcccgttccggtcccccgtcctacccgttcgtacggtccgtaaccg

SEQ ID NO: 101247 - DNA, 697 bp, Homo sapiens
  misc_feature: GYAE6OF01BJGDB.38.3.A03.1.454.CMB.1.raw
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatcctgccctgactcagcctgcctcgtgtctgggtctccgtggacngtcggtcncctatcctctgcactggaaccagcagtcgactagtttggtacttaactaaccattcggtccttaccgtggtaacccaactactaccaacccgaagaaccaaccggaccccccaaaacttcaattaactttaactcggtaacgtacgtaagttacggtccggtcccgtcgtaggggtttctgacttcgtcttacgtcacggtctaccgtaagtacgtcggacaaccgaccggtcccttacccgtacgaaccctactccgttcgtacgggtccttaccgtagggttacggaacggtacggacggtctacgtaactagtttacgtcgccgtcctacacgtagtcgaagtcgtagggtcgggtttcgggacggtacggtaacgtaaggtccgttaccgtacgttacggttaccgacgtacccggtaagtcccgtccgggtcccccgttccggtacctacccgttccgtccccggtttaccctcccccgtaccgtccgtaccgtcgtacccgg

SEQ ID NO: 101248 - DNA, 708 bp, Homo sapiens
  misc_feature: GYAE6OF01EYACH.38.3.A03.1.454.CMB.1.raw
  modified_base (259)..(259): a, c, t, g, unknown or other
  misc_feature (259)..(259): n is a, c, g, or t
  modified_base (426)..(426): a, c, t, g, unknown or other
  misc_feature (426)..(426): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacaggtcggtcgccatcctcctgcactggaaccagcagtgactagttggtacttataccatgtctctgaccaacatccaccanacaacgacccccaactcattaattatgacgtcagtacgtccggcctcgtacggggtttctgatcgtccttcgtcacggcctaccgaagtcgtaggacaaccgaccggtccctaccctacgacctatccgtcgtcggtccgtaccgtacgggttaggacgggtacggnggtctagtacttagttagttcgccgtaccctctaaccgtagtacggtaacgttacgaagggggtttacggggtttaccgggggacgggtaaccggggtaaacccgttaaacgggtacggtaaccccggtaccggttaaccggggtaccgtaccggtaacccccggaacgggtccccgttccccgggtacccccggttccgggtacccgtacccgttaccccggttcccgttcccccgggtcccccttaccccggttcccttaaccgggtccgttaacccggg

SEQ ID NO: 101249 - DNA, 779 bp, Homo sapiens
  misc_feature: GYAE6OF01D3KYW.38.3.A03.1.454.CMB.1.raw
  modified_base (755)..(755): a, c, t, g, unknown or other
  misc_feature (755)..(755): n is a, c, g, or t
  modified_base (763)..(763): a, c, t, g, unknown or other
  misc_feature (763)..(763): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctggtctcctcgcacgtcggtcgccactctcctcgcactcggaaccacgacgagtagtactacttagttacgttaactaaacctaactgttcctccgtacgtaccgaactaactaccacccaacgaacgaaaccggaccccctaaacctaactaacttaaactttaagttacgtacggtaaccgtacgttaacggtacccggtaccccgttccggtaaggggttttaccggttacgaacgttccgttaccgtttccttcgaacggtaccgtaccgtaacgtacgttcggaccgaaaccgaacccgggtcccctccccgttaccgaaccctaacgttcccgttaccgtacgggtccctaaccggtaagggtttcggaaaccgggggaaccggtaagggaccttcggtaaacttttaaacggtttgttcgtacccggcccttacgacaaccggtaggtaaccttaccgggtaagggtacgggggttttccgggaacggacggggtaaccgtaaaggtccgggtaccctaccgttaacggtacgaaccgccggtaaccgcgtccgtaccccgtcgtcaccgttcctccgtacccnccccgttntacccgagtggtaacc

SEQ ID NO: 101250 - DNA, 750 bp, Homo sapiens
  misc_feature: GYAE6OF01BSH6L.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctcgccctgactcacgcctgcctccgtgtcgtgggtctccgtggactaggtcggtcgccatcctcctgcacgtaggaaccagcagtagactagttacggttaacttaactaacctagttcgtacctccgtaggtaacccaacgactaccaacccgaagaaccaaccggaccccctaaacctactaacttaatttagtcggtaccgtacgtacggtacggtccggtacccgtcggtacgggtttcgtagacgttcgtcttctacgacggacctaccgtagtcgtacgtacgaaccgacccggtcctacccgtactacctactaccgtcggtcgggtcctacggtacgggttagaacgggtacgtaggtacgtagtacgttattacgtcgccgtacctcgtactagtacgtaacgtcgggtagggttacggggtttacgggaccgggtaacgggtaacgtaacggttaccggaccgtacggtacggtacgaccgggtacccgtaacgggtcccgtccccggtaccccggtttaccggtacccgtacccgtttacccgttccccggttaccccccgtccccgtttaccccgtaccggttaaccggtccggtacccgg

SEQ ID NO: 101251 - DNA, 768 bp, Homo sapiens
  misc_feature: GYAE6OF01DZ9YT.38.3.A03.1.454.CMB.1.raw
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
tcagtcgatcacgtcacgaccggtgctcgatttagagagcgtcacgagggggcagcgctctcaggacatctccaccatggcctgggctctgctgctcctcaccctcctcactcagggcacagggtcctgggcccaagtctgccctgactcagcctgctcgtgtctggtctcctggacngtcgtcnccatctcctgcactggaaccagcagtnactagttggtacttagaacctatcggtacttcctaggttaacccaaacactccgaacccctagaacctaaacgggccccctaaaacgtccaaagttaaactttaacgtggaaccgttacgaagttaacgggttcccggaccccgttacggtacgggttttctacgaacttcggacctttccgttcgaacgggtccttaccgaaacggttccgtaggaccaaacgtaacccgggtcccttacccgttaggacccctaagttcccgttaccggttcgggtaccgttacccgtaagggttacggacggtaacggacgggtacttacggtaacttaagttacgttcgaccgtacccgtactacacgtagaacgtcgtaaggtacgggttttacggacggtacgggtaaccgtaaacggttcggtaccgttaccgttacggtaccgtaacggtacccgaaacgggtccgtaccggtacccccgttccggttcccgtaccgttacccgttaccggttaccccgtaccccgttacccgttactaccccggttggttaacccgg

SEQ ID NO: 101252 - DNA, 605 bp, Homo sapiens
  misc_feature: GYAE6OF01CFSD4.38.3.A03.1.454.CMB.1.raw
  modified_base (191)..(191): a, c, t, g, unknown or other
  misc_feature (191)..(191): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (472)..(472): a, c, t, g, unknown or other
  misc_feature (472)..(472): n is a, c, g, or t
  modified_base (581)..(581): a, c, t, g, unknown or other
  misc_feature (581)..(581): n is a, c, g, or t
tcagtcgatcacgtcacgaccggtgctcgatttagagagcgtcacagggggcagcgctctcaggacatcctaccaccatggcctgggctctgctgctcctcaccctcctcactcagggccacagggtcctgggcccaagtctgccctgactcagcctgcctccgtgtctgggtctcctggacagtcggtcnccatctcctgcactggaaccagcagtgacattggtacttaaaccntgtctcctggtaccaanatcaccagacaagcccccaaatccataatttatgaacgtnagtagtccgcctntagggtttctggatcggcttctctaacggcctaccgaagtccgtggaccaaacgtaccggccttcccagaccctatccgtcgtcgggtcctccgtaggttcggacggtacggaacggtccgtagaacgttattacgtttcgccgtctaccgactagtgaactacgngggttagggttttcgggcggtacgggtaacgaaggttacaccggttactacggtacgccgaccaacggtctacccgccccgttacggtccaccttccgttcggtccccnccgttccctactccgtgtaacccg

SEQ ID NO: 101253 - DNA, 711 bp, Homo sapiens
  misc_feature: GYAE6OF01DOC21.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatcctgccctgactcagcctgcctccgtgtctgggtctccgtggacagtcggtcgccatcctcctgccacgtacggaaccagacaggtcactagttggtaacttaataacctattcgtccttaccgtacggttaacccaacactaccaacccgaacgaaccgaaaccggaccccctaaaactctaaatttaaactttatacgtaacgtactaggtacggtccgtcccgtacggttacgggtttctagtacgtccgtcttcctacgacggtcctaccgtaacgttccgtacggacctaaaccgccggtacccctacccgtacacctacgtcccgttcggtacggtcctaccggtaggttcgggaacggtacggtagtcttacgtaactttacgttacgtcgaccgtcctactaacgagtacggtaactacgggtagggttaaccgggttcggggacggtaacgggtacgtaacggtcgtaaccggttcgtaacggccgtacgccccgtaggcccgtaccgtaccccgtcgtaccgtccttaccggttccctccccgaccccttgacctgtcgtaccg

SEQ ID NO: 101254 - DNA, 740 bp, Homo sapiens
  misc_feature: GYAE6OF01EORDL.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacgagggtcctgggacccaatcctgccctgactcagcctgccttcgtgtcgtgggtcctccgtggactaggtcggtcgccattcctcctagctacgtacggaaccaggcaggtgactagttcgtaactagaactatcgtcctcgtacggtaaccaactactccgaaccaagaaccgaaccggaccccctaaaactctaaattaaattaagtcggacgttacgtacggtaacggttccggtccctccggtaagggggttttcctagggaacttccggtcctttacgcgtacggtacctacgtaaagtcgtaggaaccaaaccggtccggtacccttacccgagtaacccgtacttcgtcgtacgggtctacccggtagttacggaacgggtacgacggtctacgaacgtttacgttagtccgacggtacctactaagttacgacggtaactggtaacggggttacgggtttacgggacggtaacggggtaaacgtaaacgttccggttaaccgacgttacgggaccgtaccggtaaccggaaaccgtccgttacccggccccgttacggacccgttctaccgtttccgtaccccctaccgacttcccggtaagtaccggtaacg

SEQ ID NO: 101255 - DNA, 701 bp, Homo sapiens
  misc_feature: GYAE6OF01DRGAA.38.3.A03.1.454.CMB.1.raw
  modified_base (221)..(221): a, c, t, g, unknown or other
  misc_feature (221)..(221): n is a, c, g, or t
  modified_base (690)..(690): a, c, t, g, unknown or other
  misc_feature (690)..(690): n is a, c, g, or t
tcagtcgatcacgtcacgaccggtgctcgatttagagagcgtcacgagggggcagcgctctcaggacatctccaccatggcctgggctctgctgctcctcaccctcctcactcagggcacgagggtcctgggcccaatctgccctgactcagcctgcctcgtgtcgtgggtctccgtggactggtcggtcgacctatcctccgtgcctacgtcggaaaccngcgagtgactagtttacggtaacttaactaacctgttcgttccttaccgtaggtaacccaactactacccaaacccgaagaaccgaaacccgggaaccccccaaatcctaatttaagttttagtacgtacgtcgtaaggtacggtaccggtcccgtaggtttacggggtttctaggaacttccgtacctttccgacgtacggtcctaccgtaaggttcgtacggacctaaaccgccggtccctaccgtcgaacctacgtctcggtacgtcgtaccggtaagtcgggaacggacgtacggcgttacgtattacgttagtcgaccgtcctacgacgtacgtagaacgtcggtagggttcgggttacggacgggtacggtacgaacggttcgaccgtacgtggtaccgacgacccgtaaggcccgtcccggtcccgtcggtcaccttcgtacccgttccccgcctccgtacncgtcgtaaccg

SEQ ID NO: 101256 - DNA, 758 bp, Homo sapiens
  misc_feature: GYAE6OF01ECVF6.38.3.A03.1.454.CMB.1.raw
tcagtcgatcacgtcacgaccggtgctcgatttagagagcgtcacgaggggggcacgcgctctcaggacatctccaccagtggcctgggctctgctgctcctcaccctcctcactcgacgggcacgagggtcctcgggacccaattctcggccctagactcacgcctcgccctccgtgtcgtcgggtcctccgtaggactagtcgatccacctacttccgtcctgacgacgtacgggaaccagcaggtcgtacggttggttaggttaactaaatcttcgttccttgttacggtaaccaacactaccaaccaacgtactcccgaaccgaggaacctaaaaccgtacccctaaaattcctaaagtttaacttttagtacgggaacgttaaccgtaaacccgtaaaccgggtccccttaaggtaacgggtttaacctttttaccgtaacgttccgttccttttccgtacggttaccggttacctaccggtaacgttccggtaacggaacctaacccggtcccggtcccttacccgtacgacctacgtccgtcggtcggtaccctaccgacgtaggaacggtacgtacgtactactacgtttactttacgtcgacgtactctaacgtacgttaacaaccgagtaccgcttccgtacttacggggttgggtacggtcgggaccgggtacgacccgtacgtcggtacgttacggacggtccgacgacccgtacggccctacccgtccgtcgtccgtcttccccg

SEQ ID NO: 101257 - DNA, 749 bp, Homo sapiens
  misc_feature: GYAE6OF01E318P.38.3.A03.1.454.CMB.1.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
tcagtcgatcacgtcacgaccggtgctcgatttagagagcgtcacagggggcagcgctctcaggacatctccaccatggcctgggctctgctgctcctcaccctcctcactcagggcacacgggtcctgggcccaatctgccctgactcgacgcctgcctccgtgtctgggtctcgtggacaggttcgtcgccatctccgtgccacgtaggaaccngcagcgactattcggtacttataacntacgtcctacgtacgtaaccaactactccgaacccagaccaaaccggaccccctaaactccgtaatttaaatttactacggacgtacctaaggtccgtccgtcccgttacggtacggggtttctacgattccgtacttctaccggacggtccttaaccgtaacgttcggtagtaccaaccggtacccgtcccgtacccgtaccgtacctacgtccttccggtcgggtacctaccgaacgggtttacgggagggtaccggacggtcgtacgtacttagtttagtccgtaccgtcctacgtacgtacgtacgtacggtacgttagggggttacgggtttaccgggacgggtaacgggtaaccgaaacgggttccgtaacccggttaccctaaggggtcccgacggtaacccgtaacggcccgtacccggtcccgttacccgggttcccaccgttacccttccccggtttaccccgtaccccgtaccgtttaccggaccgttccggtacg

SEQ ID NO: 101258 - DNA, 802 bp, Homo sapiens
  misc_feature: GYAE6OF01BL6N2.38.3.A03.1.454.CMB.1.raw
  modified_base (193)..(193): a, c, t, g, unknown or other
  misc_feature (193)..(193): n is a, c, g, or t
tcagtcgatcacgtcacgaccggtgctcgatttagagagcgtcacagggggcagcgctctcaggacatctccacatggcctgggctctgctgctcctcaccctcctcactcgagggcacgacggtcctgggcccaatctcgcctgactcagcctgcctccgtgtcgtggtctccgtggactacggtcggtccncctatcctcctgcaactggaaccagctagtgactagttggtacttaataacctatcgtcctcgtcgtaaccactactcaacccagaaccaacgacccccaaactctaatttaattatacgtacgtaccgtagtacggtccggtcccttaggtacggggtttcctgggtacttccggtccttcgtacgcggtaccgttacgaacgtcgtacgaaccgaacccgtacccgggtccctaccctaccggtaccctaacttcccgttcggttccgggtaccgttaccgaacggggtttccggaacgggtaaccggtacgggttaccgtaacggttacttaacggtttacgttccggtacccgtaacccgttcgtaacggtacggttacggtaacgtttacggggtaacggggttttcgggggtttaccggggaaccggggtaaccgggtaaaaccggtaacggttacccggttaaccggtacccgttacgggacgaaccccggtaggtaaaccccggtccggtaccccggtacccccggttaggttaccccgtaccgttacccttcccgtttaccccaccccgttcctacccggttaaccggttcggtaacccg

SEQ ID NO: 101259 - DNA, 131 bp, Homo sapiens
  misc_feature: GYAE6OF02FPRPH.38.3.A03.1.454.CMB.1.raw
  modified_base (124)..(131): a, c, t, g, unknown or other
  misc_feature (124)..(131): n is a, c, g, or t
tcagtcgatcacgtcacgaccggtgctcgatttagagagcgtcacaggggcacagcggccctgggctgcctggtcaaggactacttccacgtgatcgactgagcgggctggcaaggcgcatagnnnnnnnn

SEQ ID NO: 101260 - DNA, 125 bp, Homo sapiens
  misc_feature: GYAE6OF02HAWIB.38.3.A03.1.454.CMB.1.raw
  modified_base (124)..(125): a, c, t, g, unknown or other
  misc_feature (124)..(125): n is a, c, g, or t
tcagtcgatcacgtcacgaccggtgctcgatttagagagcgtcacaggggcacagcggccctggactgcctggtcaaggactacttccacgtgatcgactgagcgggctggcaaggcgcatagnn

SEQ ID NO: 101261 - DNA, 127 bp, Homo sapiens
  misc_feature: GYAE6OF02IA7W5.38.3.A03.1.454.CMB.1.raw
  modified_base (123)..(127): a, c, t, g, unknown or other
  misc_feature (123)..(127): n is a, c, g, or t
tcagtcgatcacgtcacgaccggtgctcgatttagagagcgtcacagggcacagcggccctgggctgcctggtcaaggactacttccacgtgatcgactgagcgggctggcaaggcgcatagnnnnn

SEQ ID NO: 101262 - DNA, 518 bp, Homo sapiens
  misc_feature: GYAE6OF02HGN58.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctggacccaatctgccctgactcagcctgcctccgtgtctgggtctcctggacagtcggtcgccatctcctgcactggaaccagcagtgacattggtacttataaccatgtctcctggtaccaacatcaccagacaaggcccccaaatcataattatgacgtcagtagtcggccctcaggggtttctgatcgcttctcaggctccaagtctggcaacacggcctcctgaccatctctcgggctccgaggttgaggacgaggctgactattatgcgctcacatgaatcgaggtagggttttcggcggtagggaccaagtcgaccgtctaggtcacgcccgaaggccgtcgcccctcggtccactcgtcgttcccgccctcctcgaccgtgtacg

SEQ ID NO: 101263 - DNA, 506 bp, Homo sapiens
  misc_feature: GYAE6OF02F2VXE.38.3.A03.1.454.CMB.1.raw
  modified_base (312)..(312): a, c, t, g, unknown or other
  misc_feature (312)..(312): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaatcataattatgacgtcagtagtcggcctcaggggtttcngatcgcttctcaggctccaagtctggcaacacggcctccctgacccatctctgggctccgaggttgaggcgaggctgactatattgcgctcacatggaatcgaggtagggtttcggcggtagggaccaagtgaccgtcgtaggcagccaaggctcgcccctggtcactctcgttcccgccctctctacgtgacg

SEQ ID NO: 101264 - DNA, 524 bp, Homo sapiens
  misc_feature: GYAE6OF02I5K55.38.3.A03.1.454.CMB.1.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaaggcccccaaatcataatttatgacgtcagtagtcggccctnaggggtttcngatcgcttctcaggctccaagtctggcaacacggcctcctgaccatctctggcctcgagttgagcgagctgactatatgcgctcanatgatcgaggtaggtttcggnggagggaccaaggtgacccgtctacgggtcagacccgaaggcctccggccccctgggtaccaccgttcgtccggttacccgcccctcctaccgacgtcgtaccg

SEQ ID NO: 101265 - DNA, 536 bp, Homo sapiens
  misc_feature: GYAE6OF02HZQSL.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaatcataatttatgacgtcagtagtcggccctcaggggtttctgatcgcttctcaggctccaagtctggcaacacggcctccctgaccatctctgggctccgaggttgaggacgaggctgactattattgcgcctcacatggaatcgaggtagggttttcggcgggtagggaccgtaaagtcgacccggtactacgggtcacgcccaaggccgtcgcccccgtcggtccacctcgtcgttcccaccctccctctaccgtgtaccg

SEQ ID NO: 101266 - DNA, 537 bp, Homo sapiens
  misc_feature: GYAE6OF02HUKW3.38.3.A03.1.454.CMB.1.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcaataatttangacgtcagtagtcggcctcaggggtttcngatcgcttctcaggctcaagtctggcaacacgcctcctgaccatctcgtgggctccgaggttgaggacgaggctgactattatgcgctcacatgaatcgagggtagggtttcggcgggacgggacgaagtcgaaccgtcgtacggtcacgccgaaggccgtccggacccccgttcggtccaccgttccgtcgttcccctacccttccctcctacgtcgtacg

SEQ ID NO: 101267 - DNA, 523 bp, Homo sapiens
  misc_feature: GYAE6OF02G86F7.38.3.A03.1.454.CMB.1.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (515)..(515): a, c, t, g, unknown or other
  misc_feature (515)..(515): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggcccccaaatcaattaatttangacgtcagtagtcggccctgagggtttcngatcgcttctcaggctccaagtctggacaacgacggcctccctgaccatctctgggcctcgaggttgaggacgaggctgactattatcgcgtcctcacagtgaatcgagggtgggttttcggcgggagggaccgaagtcgaccgtctagtcacgccgaaggccgtccgcccctcggtcacgtctcgttcccacctcctcncgtgtacg

SEQ ID NO: 101268 - DNA, 648 bp, Homo sapiens
  misc_feature: GYAE6OF02H59AE.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatccaccagacaacggcccccaaactcaataattatgacgtcagtacgtccggccctcgaggggtttctgatcgtcttctcgaggtcctaccaagtctggacaacgacggcctccctgacctatcctcgtcgggtctccgaggttggaggacgaggtctgtacttattattcgccgtccttacactagtacggaatcggtaaggggttacgggttttaccgggacgggacggggtaaccgtaaagggtccggtaacccgttaccggttaacgggtccgtaaccgacccggaacggtcccgtacccggtccccccgttcgggttacccctaaccgttcccgtttcccgttaccccccttacccccgttccccgttaccgtacccggttacgtaacccgg

SEQ ID NO: 101269 - DNA, 645 bp, Homo sapiens
  misc_feature: GYAE6OF02GFXYT.38.3.A03.1.454.CMB.1.raw
  modified_base (228)..(228): a, c, t, g, unknown or other
  misc_feature (228)..(228): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttanaaccatgtctcctggtaccaacatcaccagacaacggcccccaaactcataatttatgacgtcagtagtccggcctcgtaggggtttctgatcgtcttctcaggtcctaccaagttctggaccaacgaccggccctccctacgaccctactcctcgtgggcctcccgtaagggttcggaacgggaaccgagggctacgtaacttaatttaattcggccgtccctaccactaacgtggtaactacggtaagggttagggttttacggggacgggtaacggggtaaccgaaaggtacggtacccgtaccggtaaggttaccgacgaccccgaaggtccgtccggtcccccgttacggtccctaccgttccgttacgttcccccgtaccccttcccctaccgtaccggttcgtaacccgg

SEQ ID NO: 101270 - DNA, 651 bp, Homo sapiens
  misc_feature: GYAE6OF02IQPCQ.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatcctcctgcactggaaccagcagtgacattggtacttataaccatgtctctggtaaccaacatccacccagaaccaacggacccccaaactcaattaatttatagacgtcaggtacgtcggccctcgtagggtttctactcgtcttctcgtcggctctaagtttcgacaacgacggtcctcctagacctatttctcgggcctccgaggctaggacgggaacggaggtctagtaatttttagtcgtccttcctactaattactacgacggtcacgacacgtacctaacccctttattcgttaccgtttacgggaaccttcggggaaccctaaaggttaccctacccggttaccttaccggtccgaaccggaccccgtaaacgggacccccaaacccccgtacgttacggttaccctaccgttcccgttacccggtttacccccgtccccttaccctacccgg

SEQ ID NO: 101271 - DNA, 564 bp, Homo sapiens
  misc_feature: GYAE6OF02HWSMC.38.3.A03.1.454.CMB.1.raw
  modified_base (286)..(286): a, c, t, g, unknown or other
  misc_feature (286)..(286): n is a, c, g, or t
  modified_base (387)..(387): a, c, t, g, unknown or other
  misc_feature (387)..(387): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaactcataatttangacgtcagtagtcggcctcgaggggtttctgatcgtcttctcaggctcaagtctgcaacacggcctcctgaccatctcgtcggtctccaggttgaggacgnggctagacttattattgcgtccttacacgtatggaaatcgagggttagggttttacgggcggtacgggaaccgaaaggtcgaccgttcgtaggtcgacgtccgaacggcgtccgtaccccgtcggtctaccgttcgttaccgttcccggtccccttacccgtccgtaccgtgtaccg

SEQ ID NO: 101272 - DNA, 123 bp, Homo sapiens
  misc_feature: GYAE6OF02HQ5F4.38.3.A03.1.454.CMB.1.raw
tcagtcgatcacgtcacgaccggtgctcgatttagagagcgtcacaggggcacagcggccctgggctgcctggtcaaggactacttccacgtgatcgactgagcgggctggcaaggcgcatag

SEQ ID NO: 101273 - DNA, 525 bp, Homo sapiens
  misc_feature: GYAE6OF02I83JJ.38.3.A03.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccngcagtgacattggtacttataaccatgtctcctggtaccacatcaccagacaaggccccaaatcactaattangacgtcagtacgtcggacctcgagggtttctggatcgcttctcaggctccaagtctggctaacacggcctcctgaccatcnctggctcaggttgacggacgaggctgactagttattgcgctcgacagtgatcgaggtagggtttcggacggaggacctaagtcgaaccgtctaggtcaccgccaaggctcggacccctgggtcaccgttcgtcggttcccgaccctccgtcgtaccgtgtacg

SEQ ID NO: 101274 - DNA, 630 bp, Homo sapiens
  misc_feature: GYAE6OF02G9BGG.38.3.A03.1.454.CMB.1.raw
  modified_base (285)..(285): a, c, t, g, unknown or other
  misc_feature (285)..(285): n is a, c, g, or t
  modified_base (414)..(414): a, c, t, g, unknown or other
  misc_feature (414)..(414): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcataatttangacgtcagtagtcggcctcgagggtttctgatcgtcttctcaggtcctcaagtctggcaacacggcctccctgacccatctcgtgggctccgaggtttgaggacgaggctgtactattattgcgtcctnacagtggaactcgtaagggtacggggttttacgggacgggtaacggggaaccgtaaacggttcggtaacccggttcccggttaagggtccgaaccggtaccccgtaaagggtcccgttcccgggtaccccccgtccggggttacccgtacccgttaccggttcccggttcccccggtaccccgtttccccgtacccgtacccggttcgtaacccgg

SEQ ID NO: 101275 - DNA, 691 bp, Homo sapiens
  misc_feature: GYAE6OF02IEWLZ.38.3.A03.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (684)..(684): a, c, t, g, unknown or other
  misc_feature (684)..(684): n is a, c, g, or t
tcagtcgatcacgtcacgaccggtgctcgatttagagagcgtcacaggggcgagcgctctcaggacatctccaccatgcctgggctctgctgctcctcaccctcctcactcaggcacaggtcctgggcccaatctgcccctgactcagccctgcctccgtntcgtgggtcctccgtgacngtcggccgccatctcctgcactggaaccngcagtgacattggtacttanaaccnttgtcctcctggtaccaacatccaccanacaacgacccccaaatcaataagtttacnacgtctaagtacgtccgccctgtaaggggtttctggattccgtcttctacgaggtcctacgtaagtcgtacgacctaacgtccggcccttcccgtagacccctaagttcccgtacgtcgggtccttccggaggtttacggccgggtaaacgtcggtcgttacgaaccgtttaagttctttacgggccgtacccttacgaactaacggtaggtaaaccgtcggttaacggggttaacggggttttccgggaacggggtaaccgggaaaccgtaaacgggttcgaaccccgggtttactaaccgggtacgtacgaccccgttaaggcccgtaccgtcccccggttgtacccaccgtccgtttcggtacccccgccccgttacggtctaccgggtntaacccg

SEQ ID NO: 101276 - DNA, 652 bp, Homo sapiens
  misc_feature: GYAE6OF02H64GQ.38.3.A03.1.454.CMB.1.raw
  modified_base (334)..(334): a, c, t, g, unknown or other
  misc_feature (334)..(334): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactagttggtacttataaccatcgttactcctggtaccaactatccaacccagaaccaacggaccccccaaactcaattaatttactgacgtacagtacgtcggccctgtaggggtttcngatcgtcttctcgagcctaccaagtctggaccaacgaccggtccctcccagaccctatcctcgtacgggtcctaccgtagggttcgacgggacggagggtctggtacttagttacgtttcgccgtccttacacgtagtagaactcggtacgggttacgggtttaccgggacgggtaacgggaaccgtaaaggttccgtaccgggtaccgtaaggtaccgaccgtacccgaacggtcccgtcccgtcccccgttcggcccttaccgtccgttcccgttacccccgtccccgttaccctccgttacccggtgttacccgg

SEQ ID NO: 101277 - DNA, 562 bp, Homo sapiens
  misc_feature: GYAE6OF02ICRK1.38.3.A03.1.454.CMB.1.raw
  modified_base (356)..(356): a, c, t, g, unknown or other
  misc_feature (356)..(356): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggcccccaaactcataatttatgacgtcagtagtcggcctgtaggggtttctgatcgcttctcaggctccaagtctggcaacacggcctcccngaccatctcgtgggcctccgaggttgaggacgaggctagactattagttgcgtcctcactagtgaatcgtaagggtagggttttccgggacgggtaacgggaccgtaaacggtcgaaccgtaccgtacggtcgacgacccgaaggtccgtccgtccccgtcggtcctaccgttcgtcgttcccacccttcctcgtaccgtcgtacg

SEQ ID NO: 101278 - DNA, 944 bp, Homo sapiens
  misc_feature: GYAE6OF02GWUQ2.38.3.A03.1.454.CMB.1.raw
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtcctcctggtaccaacactacacccagacaacggccccccaaatcaataatttangacgtacagtacgtcggccctcgtaggggttttcngattcgccttctcgaggtcctaccgaagtctcggaccaacgaccggtccctacccgtacgaaccctactccgttccgtcggggtccctaccgtaacgggtttcggaacgggtaaccgggtaacggtccgttaacggtaaccgtttaagttttaccggtttacgggaccccggttaccccttaacccgaaaccgttaacgggttaacgggtaaacgttaccgggttaaacgggggggtttaacggggggttttttaaccgggggggaccgggggttaaacgggggtaaaaccccgggttaaaaacgggggtttacccgggtaaacccccgggggtttaacccgggtttaaacccgggggttacccgtaaaaaccccgggggttaccccccgggtaaaacccgggggttaccccggtttacccccgggggtaaccccccccccccgggtttttaacggggggtttaacccccccgttaaaacccccggttttacccccgggtttttaaccccccgggttttaacccccccccgttaaacccccccccccgggtttttacccccgttttaaacccccgggtaaacccccggggttttaccccgggtttaaaaccccccgggg

SEQ ID NO: 101279 - DNA, 668 bp, Homo sapiens
  misc_feature: GYAE6OF02FNGC8.38.3.A03.1.454.CMB.1.raw
  modified_base (208)..(208): a, c, t, g, unknown or other
  misc_feature (208)..(208): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccngcagtgacattggtacttataaccatgtctcctggtaccaacatcaccagacaacgcccccaaactcataatttatgacgtcagtacgtccggcctcgtaggggtttctgtactcgtctttcctcgacggctacctaagtcgtggaccaacgaccggtccctcccgtacgaccctactcctcgtcgggtcctcccgtaaggttcggaagggacggacgggtctagtaacttagtttacgttcgaccgtacccttcgacgtaagtacggtaaactccgaaggggttacggggttttccgggaccggggtaacgggtaaacccgtaaaggttaccggaacccggttccgtaacggttaccgaacggtacccgaagggtcccgtaccggccccccgttacgggtaccctaccgttccgttaccgttccccgtaccccgttcccgtaccgtaccggtgtacccg

SEQ ID NO: 101280 - DNA, 547 bp, Homo sapiens
  misc_feature: GYAE6OF02G3MYI.38.3.A03.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccngcagtgactattggtacttataaccatgtctcctggtaccaacatcaccagacaacggcccccaaactcataatttangacgtcagtagtcggccctctaggggtttctgatcgcttctcnggctcaagtctggcaacncggcctcctgacccatctctggcctcgaggttgaggacggtaggctagacttattattcgcgtcctcactatgaactcgtagggtagggtttcgggcgggagggacgaagtcgaccgtcgtaaggtcgacgccgaaggccgtcggtccccgtcggtaccaccgttctccgttccccacccgtccctcgtaccgtgtaccg

SEQ ID NO: 101281 - DNA, 768 bp, Homo sapiens
  misc_feature: GYAE6OF02FP2TJ.38.3.A03.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (571)..(571): a, c, t, g, unknown or other
  misc_feature (571)..(571): n is a, c, g, or t
tcagtcgatcacgtcacgaccggtgctcgatttagagagcgtcacagggggcagcgctctcaggacatctccaccatggcctgggctcgtcgctgctcctcacccgtcctcactcaggcacgacgggtccgtgggcccaatctcgccctgactcacgcctgcctccgtgtctcggtctccgtgactgtcgtcnccatcnctgcacgtcgaaccngctagtgacgtagttcgtactttanaaaccgtatcgtcttccgtagtaacctaacgtactacgaacctacgaaccgaaaccggaccccctaaaactcctaattaactttagtacgtaccgtctaaggtccgtccgtcccttacggttacgggtttctacggtacgttccggtcgttacctaccgacggtcccttacggtaacggttccggtacggtaacctaaaccggtacccggttccctacccggtttaacgtaaacccttacgtttcccggttaccgtacggggtaccctaccggttaacggggtcggaaacgggtacgtacggttccgttaaagtaacctttaagggtttacnccgtttaccggtacctaaccgtacttacggtacggtactaacggtacggggttacgggttaacggccggaaccgggtaaccgtaacgtccgtaaccgttcgtaacgtccacggtaccgaaccggttcgtcccggaccccgttagtaccgtacgttccgttaccggtccccgtacccttaccgcttaccgtggtaccg

SEQ ID NO: 101282 - DNA, 551 bp, Homo sapiens
  misc_feature: GYAE6OF02GXHKI.38.3.A03.1.454.CMB.1.raw
  modified_base (373)..(373): a, c, t, g, unknown or other
  misc_feature (373)..(373): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaaggcccccaaactcactaattatgacgtcagtagtcggcccgtcaggggtttctgatcgtctctcaggctccaagtctggcaacacggcctcctcgaccatctctggctccnggtcgaggacgaggcgtgactacttatcgtcgcctcactatggaatcgaggtagggtttcggacgggtagggaaccgtaacgtagaccggtccgtaacggtcgacgtcccgaacggcgtcgtcccccgtcggtccaccgtccgttcggttcccctaccctccctccgacgtcgtaccg

SEQ ID NO: 101283 - DNA, 735 bp, Homo sapiens
  misc_feature: GYAE6OF02JLUV1.38.3.A03.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagtcgatcacgtcacgaccggtgctcgatttagagagcgtcacagggggcgagcgctctcaggacatctccaccatggcctgggctctgctgctcctcaccctcctcactcagggcacgagggtcctgggcccaatctgccctgactcagcctgcctccgtgtctgggtctcctggacngtcggtcgccatcnctagcactggaaccagccagtgacatttggtactttaataaccattcgtccttctcggtaaccaacactaccgacccaagactaacggcccccaaaactcaagttaattaactgactaccagtacgccggccctagttagggttcctagacttccgctttactcgacggtcgtacctaaggtcctaggaccaaacgtccggccttccctacgaccgtatcctttcggacggtctaccgtaaggttggaacgggcggtaagcgtaaccgtattacgtttacgttcgccggtcccttaccgaacgtacgtagggttaaactacgttaagggggttaacccggggtttttcgggacggggtaaacccggggtaaacctaaaccgggttacgtaaacccgggttcccggtttaagggaacggtaccccgtacgtaaaacgggttccccgtcccggtaacccccggtcgggttacccaaccggtttccggtttaaccccgttccccggaacccccggttttcacccccggttagttcgggtaacc

SEQ ID NO: 101284 - DNA, 534 bp, Homo sapiens
  misc_feature: GYAE6OF02G45X5.38.3.A03.1.454.CMB.1.raw
  modified_base (512)..(512): a, c, t, g, unknown or other
  misc_feature (512)..(512): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtacaacatcaccagacaacgccccaaactcataattatgacgtcagtagtcgcctctaggggtttctgatcgcttctcgaggctccaagtctggctaacgacggcctcctcgaccatctcgtcgggtctccgaggttgaacggtacgaggctgacttagtatcgcgcctgactatcggatcgagtagggtttcggacgggtaggaaccaagtcgaccggtctagtcacgaccgaggctcggcccctcggtcctacgtctccggttcccncccgtcctccgtacgtgtaccg

SEQ ID NO: 101285 - DNA, 836 bp, Homo sapiens
  misc_feature: GYAE6OF02HODBU.38.3.A03.1.454.CMB.1.raw
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggccccaaatcaataatttangacgtcagtagtccgcctcgaggggtttcngactcgctttcncgaggctaccgaagtccgtaggaccaacgaccggtccctccgtacgaaccctaacgtccgtacgtcgggtccgtacccgtaacgggtttacggaacgggtaacgggtaacgggtaccgttacggtaaccgtttaaacgtttaacgtttaccgggtcccgtaccccgtttaaccgaacccgttaacggtaacgggtaaacgttaccgggttaaacgggggtttaaccggggggttttttaaccggggaccgggggttaaaccggggtaaacccggtaaaaccggggtttaacccgggtaaaccccgggtttaacccggttaaccggggtttaaccgaaccgggtaaccccggtaaacgggttaccccggttaaccccgggttacccccccggtttacccgggttaaccccggttaaccccgtttacccggtttaccccgggttttaccccccggttacccccgtttacccccgtttaacccggttacccgggttaccggttaaaccccggg

SEQ ID NO: 101286 - DNA, 907 bp, Homo sapiens
  misc_feature: GYAE6OF02JZVGZ.38.3.A03.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctccgtggacagtcggtccnctatcctcctgcacgtcggaaccngacgtagtgaacctagttcggtaaacttactaaccgattcgtcctccgtaggtaaccaactactaccaccccgtaagaaccgtaaaccggaccccccaaagtacctaacttaacgtttacgacgtaaccgtaccgtaacggtacggtacccggtacccgttacggtacgggggttttacctacggtaaccttacccggttaccgtttaccgtaccggtaccgggtaccctaacccggtaaacggttccgtacgggtaacccgtaaacccggtacccggtaccccgttacccgtaacccggtaacccttaaccggttcccggttacgggtacgggttacccgtaaccgggtagggtttaccgggaacgggttaaccgggacgggttaccgtaaggttaacgtttaacgtacgttccggaccgtcccgttaacgtaacggtagtaaccggtaagtccggggtaagggttaccggggtttacggaacggggtaaaccggtaaaccgttaacggttacccgggtaacccgtacggttaccggtaaccggtaacccgtacccggggtaaccgtacccggtaaccccgggtaccccgtttaaccgggtaaccccttacccggttaacccggtttcccccggttaacccccgttaacccccgttacggttaaccccggtaccggttagtttaaaccccggg

SEQ ID NO: 101287 - DNA, 593 bp, Homo sapiens
  misc_feature: GYAE6OF02J1NEV.38.3.A03.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctccgtggacngtcggtcnccatctcctgcactggaaccagcagtgactattggtacttataaccatgtctcctgtacacntcaccagacacgccccaactcataattatgacgtcagtacgtcggcctcgtagggtttcngactcgtcttcncgtagctacagtctggacacgaccgcctcctgacctntctacgtcggtctccgtaggtgacggacgtagctagtacttagttagtacgcctcctcacgtacgtagtactcgtagggttcgggtttacggacgggtaacggtaccgaaacggttccgtaaccggtccgtaacggtcaccggtaccgaacggtccgtcccggtaccccgtggtacccgtaccttccggttcccgttacccccgcccgttacccgtacgtaccgttcgtaaccg

SEQ ID NO: 101288 - DNA, 594 bp, Homo sapiens
  misc_feature: GYAE6OF02IE1SG.38.3.A03.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (529)..(529): a, c, t, g, unknown or other
  misc_feature (529)..(529): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctcgcctcgtgtctgggtctcctggacagtcggtcgccatctcctgcactgaaccngcagtgactattggtacttacaacntgtctcctggaccaacatccaaccagaccaacggacccccaaatcaattaattacngaccgtnaaggtacgtccggtcctgtacggggtttctgtactcggtcttctcgaggtcctactaagtctacggacaacgacggcctccgacaaccctatcctcgtcgggtcctcgacgggttcgaaacgggcgacggtctacgtacttacttcgtcgctcctactaactgtacgtaacgtacgtagggttacgggtttaccgggcggaacggtaacgaacggtacgaccgtacgtgtaccncgaccgaacggcctcgtccccgtagtcctaccttccgtcgtccctccctctaccgtcgtactacg

SEQ ID NO: 101289 - DNA, 781 bp, Homo sapiens
  misc_feature: GYAE6OF02F7T8V.38.3.A03.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacngtcggtcgccatctcctgcactggaaccngcagtgacattggtacttataaccatgtctcctggtaccanatcaccagacaacggacccccaactcataatttatcgacgtcagtacgtccggccctcgtagggttctgactcgtcttctcgacggtcctaccgaagttcgtggaccaacgccggtcccttcccgtacgaccctacttcccgtcgtcggggtccctaccggtacgggtttacgggaacgggtacggaacggggtccttacggtaacctttaacgtttacgttccggtacccggtacccttaccgtaaccgtaacgttacggggtaaactttaccgggtaagggggtttaacgggggttttttacccgggggaccggggggtaaaccgggggtaaacccgttaaaggggttacccgggtaaccccgggtttaccggttaagggtacccgtaaccgggaccccggtaaccgggtcccggtacccccgggttaccccccggtttcccgggaacccggttaccctttaccccgttccccggtttcccccgtacccccggtttccccgttacccggttaccggttacccggtaccgg

SEQ ID NO: 101290 - DNA, 656 bp, Homo sapiens
  misc_feature: GYAE6OF02J2F79.38.3.A03.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctcgggcccaatctcgccctgactcagcctgcctcgtgtcgtgggtctcgtgacngtcgtcgccatctccgtncactcggaaccgctagtnactgttgtaacttacaacatcgtcctcgtacgtaaccactactccaccagaaccgtaacccgaccccaaactactaattaatttanacgtacgtacgtagtaccgtccggtacccttggttaacgggtttcagtactccgtnttaccgcgtacgccgtacagtcgtagtaccaacgccgtcctacgtcaacctctaccgcgtcggcctgtacggtgacgacgagtctagtacttatcncgccgtactcagtacgacgtactcgggtaacgggttcgggttccggaaccgggtaacggaacgtaacggtccggtaaccgtaccggtacgcggtaacccgacgggttaccgtacccggtacccgtccccggttgtaacccggtttaccgtccggtttcccccgggttccctccccgttacgtccggtaccgttccggtaacg

SEQ ID NO: 101291 - DNA, 692 bp, Homo sapiens
  misc_feature: GYAE6OF02HND2M.38.3.A03.1.454.CMB.1.raw
  modified_base (208)..(208): a, c, t, g, unknown or other
  misc_feature (208)..(208): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccngcagtgactagttaggtacttataaccattcgtccttccgtggtaaccaacactccacccagaccaacgaccccccaaactcaattaattactacgtacgtacgaaggttacggttccggccctacggtaggggttttcctgtactccgtctttctcgacggtcctacctaagtcgtcggactaaacgaccggtccctccccgtacgaccctacttcctaccggtcgggtcctaccggtagggtttcggaacgggtacgggacgtcgtagtaacttagtttacgtcgccgtcctaccagtcgtgaacgtcgtaggggttcgggtttacgggacggaacgggaccgtaaagtccgaccggtaccgtagggacgaccgggtacccgacggtcccgtcccggtcccccgttacggtacccgtacccgttcccgttcccggtttccccccgtccccgttcccccgtaccgttccggtacgttacccgg

SEQ ID NO: 101292 - DNA, 802 bp, Homo sapiens
  misc_feature: GYAE6OF02GEP76.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacacgggtcctgggcccaatctgccctgactcagcctgcctccgtgtctgggtctcctggacagtcggtcgcctatcctcctgtccactacgggaaccagcctagtcgacctagtttacggtaaccttaactaacccagttcgtccttacccgtacggtaaccctaaacgaccttaccaacccccgaacggaacccgaaacccgggacccccctaaaactcctaactttaaacgtttagtacggtaccgtctaacggttacggtccggtacccgttacggttaacggggttttcctagggtaccttccggttacctttccgtacggtaccgggtccttaccgtaacggttcccgtagggaacccaaacgtaccccggtcccttaccccgtacgtacccctacgttccgtacggtccgggtaccgttaccggttacgggtacggaacgggacggtacggtacgttacgtaactttagttacgttacgcccgtactacgaacgtagtacggtacgtacgggttaacgggtttcggggttaccgggacgggtaaccggtaaccgtaaagggttccgaaccgttacggtagtaccgaccggaccgtaacggtccgtccccggtaccgtaccggttcctaccgttccgttacccgttccccacccgtttccgaccgtacggtcttaccgg

SEQ ID NO: 101293 - DNA, 667 bp, Homo sapiens
  misc_feature: GYAE6OF02F08T3.38.3.A03.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctgccctgactcagcctgcctccgtgtctgggtctcctggacngtcggtcnccatctctgcactggaccagcagtgacctagtttggtaacttactaaccattcgttcctccgtggtaaccaactactccaaccagaccaacggacccccaaactcaattaattacagaccgttcagttcggtccggccctggtacgggtttctgactcgtcttcgtcgacggtctaccgtaagtccttggacctaccgtaaccggtccctccgtacgtaccctactccgttaccgtcgggtcctaccggagggttacggacgggacggtagtctagtacgtttattacgtcgtaccgccgttaccaacgtagttcggtaactcgggtacgggttagggtttccgggacgggtacgggtaaccgtaaggttaccgaccgtacgtaacgggtacctaccgggcgtaacgggccttcccgggaccctcgggttacccaccgtttccgtcctccccgtaccctccgtacctagtcgtaacccg

SEQ ID NO: 101294 - DNA, 792 bp, Homo sapiens
  misc_feature: GYAE6OF02HJT10.38.3.A03.1.454.CMB.1.raw
  modified_base (725)..(725): a, c, t, g, unknown or other
  misc_feature (725)..(725): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgagggtcctgggcccaatctgccctgactcagcctgcctccgtgtctgggtctcctaggacaggtcggtccgaccattcctccgtgcctacgtaggaacccagtaccaggtcgactagttggtaactttataaacccattcggttcctcccttagggtaaccctaaacacttacccaacccagaaccgaaaccgggtacccccccaaaacgttccaaatttaaacctttaagtacggtaccgttaccggtaaggttaaccggttcccgggtaccccttaccggttaacggggggtttttcctacggtaacgttacccggtccttaccgttcgacggtaccctaccgtaacgttcggacggtaccaaaccgaccggtaccctccgtacgaccctacgttcctccgtacgggtcccttacggagggtttacggacgggtaaccggaggtcgtaacgtacgttaaacgtttctacgggtccctaccttacgaccgttaacgtacggtaactacgggtaaccgggtttacggggtttccgggaacgggtaacgggtaacgtaaacggtcgtaccgtacgttacgacgtccgacccggtaagtcccgtccnccccggtcttaccgccgttacgttcccgttacccctcccgttacccgtaccgtaccgtacgtaccgg

SEQ ID NO: 101295 - DNA, 691 bp, Homo sapiens
  misc_feature: GYAE6OF02HKP2R.38.3.A03.1.454.CMB.1.raw
  modified_base (177)..(177): a, c, t, g, unknown or other
  misc_feature (177)..(177): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (678)..(678): a, c, t, g, unknown or other
  misc_feature (678)..(678): n is a, c, g, or t
tcagtcgatcacgtcacgaccggtgctcgatttagagagcgtcacgagggggcagcgctctcaggacatctccaccatggcctgggctctgctgctcctcaccctcctcactcagggcacagggtcctgggcccaatctgccctgactcagcctgcctcgtgtctggtctctggacngtcgtcgccatctcctgcacgtgaaccngcagtgactagttcgtacttanaacctagtcgtaccttccgtacggtaaccaactactccaacccgaacgaaccgtaacccggaccccctaaaactaccgtaattaaactttagtacggtacctacgtaacggttaacggtcccggtacccgttacggttacggggttttcctaggtactccggtccttcgtacgtacgtcctacgtaagtccgtacgaccaaacgtccgtccttccgtagtacctacttcgtcgtacgggtccttaccggtaggttacggacgggtacgtggtactagtaacttacgtttacgttcgccgtacctacacgtaggtaagtactacgggttagggttacgggtttcgggacgggtaacggtaacgtaacggtcggtaaccgtccggttagccgtaacgaccgtacgtccgtaccggcccgttacgctaccgtcgttcccgtccctcccgttacncctaggtctaacg

SEQ ID NO: 101296 - DNA, 728 bp, Homo sapiens
  misc_feature: GYAE6OF02GM4NK.38.3.A03.1.454.CMB.1.raw
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
tcagtcgatcacgtcacgaccggtgctcgatttagagagcgtcacagggggcagcgctctcaggacatctctaccatggcctgggctctgctgctcctcaccctcctcactcagggcacagggtcctgggcccaatctgccctgactcagcctgcctccgtgtctgggtctcctggacaggtcggtcgccatcctctgctacgtggaaccngcagtgactagttggtacttaataaccatcgtcctctaggtaccaacactccaccagacaaccgaccccaaactctaattaatttancgtacgtcagtacgtccggtcctcggttacgggtttcgtgacgttcgtcttctacgacggtacctacgtaacgttcgtacggacctaaacccgacccggtaccccttacccgtaccgtaacccgtacgttccgttaccggttaccggggtccgttacccgggtaaggggtttacggaacggggtaccggacgggtaccgttacgtaacgtttagtttacggtcgtcccgtacctaccgtaacgacggttacgaacgttacgggtaggggtttacggggtttacgggaccgggtagggaaaccgtaacggttccggaccggttacgtacggtaccgaaccggccggacggtaccggtccccgtacccggttaccgtccttaccgttccgttacccgttccccgtacccttccgtaccgtacgtcgtaaccg

SEQ ID NO: 101297 - DNA, 716 bp, Homo sapiens
  misc_feature: GYAE6OF02F5UCQ.38.3.A03.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (457)..(457): a, c, t, g, unknown or other
  misc_feature (457)..(457): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcnccatctcctgcactggaaccngcagtgactnttggtacttanaaccntgtctcctgtaccaacatccaccagacaacgcccccaaatcaataatttancgacgtcagtacgtccggcctcggtaggggtttctagacgttcgtctttacgtcgacggtaccttaccgtaagttccgtacggacctaaccgtaaccggtccccttcccgtaacgaacccttacgttccttaccggttcgggccgttccggtaggttacgggacggtacggnggtacctagtacttaattagttcgtccgacctacaaccgtagtaggaacttcgggtaagggttaacggggttttccgggacggggtaaacgggtaaccgtaaagggttaccgtacccggttaccggtaacgggttaccgaaccggtacccgaacggtcccgtcccggtacccccgttccgggttacccgtaaccggtttcccgttacccggtttccccggtaccccgttacccgtaccggttacccggtgtaaccccgg

SEQ ID NO: 101298 - DNA, 751 bp, Homo sapiens
  misc_feature: GYAE6OF02FLMMI.38.3.A03.1.454.CMB.1.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgccctccgtgtctgggtctcctggacagtcggtcnccatctcctgcactggaaccngcagtgacagttggtactataaccatcgtctcctggtaacccaacactcaacccagaaccaacggaccccccaaatcattaaatttaancggaacgtcagtacgtccggtacctcgtacggggtttctagaacgttcgtccttacgtcgtaacggccttacaaacggttcgtcggaaccaaacgaccggtacccttccccgtacgtacccaacttcctccgtcgggtacctccggtaaggttcgggaagggaccggtacgggtctacggtaccttaagtttagttcgccgtacctacgacctagtacgggtaactacggaacggggttagggttttccggggaccgggaacggtaacggtaaacggtacggtaacccgttcgttaaacggtaccgaacccggacccggtaaaccgggtacccggtacccgggtacccccccggtttaccggggttaacccgtacccgtttacccggtttacccgggttcccccggtaccccggtttaccccgtaccggttaccgggtacccggttaacccgg

SEQ ID NO: 101299 - DNA, 909 bp, Homo sapiens
  misc_feature: GYAE6OF02IK0OF.38.3.A03.1.454.CMB.1.raw
tcagtcgatcacgtcacgaccggtgctcgatttagagagcgtcacagggggcagcgctctcaggacatctccacatggcctgggctctgctgctcctcaccctcctcactcagggcacagggtcctgggcccaatctgccctgactcagcctgccctccgtgtctgggtctccgtggacaggtcggtccgccatcctccgtgcacgtaggaacccagccagtcgactagtttggtaacttactaaaccatcgtaccttcccgtaggtaacccaactactaccaacccagaaccaaccggacccccaaaactctaagtttaaacttatacggtaccgttactacggtacggttcccggtcccgttcggttacgggggttttctggacttccgtacctttccgttacgacggtcctacccgtaaagttccgtacggaccaaacccggtacccggtccccttaccccggtacgtaacccctaacgtttcccgtccgggtttcggggtacccttacccgggtacgggtttacggaacgggaaccgggtacgggtaccgttaggtaaccgttacgttttaacggttcggtaccgttacccgttaacctaccgttaacggttacgggttaaccgggtttaaccgggtacgggggtttaccggggggtttttacccggggaaccgggggtaaaccggggtaaacccggttaaacgggttacccggggttaacccggtttaccccgggttaaacgggttaaccccggtaccggggtaccccggtaaccggggtaccccggttccccgggttaccccccggttacccgggttaacccgttacccgtttaacccgtttcccccgtttacccccgtaccccgtttaccccgttacccgttaccggttaccgttaacccgg

SEQ ID NO: 101300 - DNA, 632 bp, Homo sapiens
  misc_feature: GYAE6OF02JB5NZ.38.3.A03.1.454.CMB.1.raw
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagtcgatcacgtcacgaccggtgctcgatttagagagcgtcacagggggcagcgctctcaggacatctccaccatggcctgggctctgctgctcctcaccctcctcactcaggcacgaggtcctgggcccaatctgccctgactcagcctgcctccgtgtctggtctccgtggacagtcggtcnccatctcctgcatggaaccgtcagtgactattggtaactataaccntgtcctcctggtaaccaactctcgtaaccccagaccgtaacggcccccaaaatcgtaattaacgtttancgtactcagtacgtcgcctgacgggtttcngtagtcncgttctgtacggctaccgaacgttcgtacggtcaaatacccgggtctaccctagacctatccgtcttgggcttacccggtaggtacgacgggttaacgaggtactacggtactaagttccttcggcctcgtaccctagaattcggaatccgagggtcgggtttcggacgggtacgtaacgaacggtcgtaaccggttctaagggtctaacccggtccgaacgttcgtacccggcccttaacggtaccacttccgtccgttaacccggcctttacccgcgttacggtctaaccgg

SEQ ID NO: 101301 - DNA, 743 bp, Homo sapiens
  misc_feature: GYAE6OF02HTSTV.38.3.A03.1.454.CMB.1.raw
tcagtcgatcacgtcacgaccggtgctcgatttagagagcgtcacagggggcagcgctctcaggacatctccaccatggcctgggctctgctgctcctcaccctcctcactcagggcacgacgggtctcgggcccaatctcgccctgacctcgacgcctcgcccttccggtgtccgtcgggtcctccgtaggacgacggttccggtccgcctacttccctccgtcggactacgtacggaaccacgacgagtacgacttagtttacggttaaactttaactaaacctattcgtaccttaccgtacggtaaccaactactacccaaccccgaagaaccgaacccgaaccccctaaactactaaacttaattttacacggtactacggtaggtaccggtccgtacctacgggttagggttctagtcttcgtcttcgtacgcggtcctacgagttcgtacggaccaaacgccgtaccctccagtaccctactcgtcgtcggtcctacggtggttacgaacgggtacggacggtatagttaacttattacgtaccgtcctacctacaccgtagtaagggtactacgggttaacggggttcggggttacggacgggtaaccgggaaccgtaaggtaccgtccgtacgtagtccgacgacccggtaagtcccgtcccggtaccccgtcggtacctacccgttcgttccccgtaccccgttcccttacccggtacgtaccggtatacccgg

SEQ ID NO: 101302 - DNA, 837 bp, Homo sapiens
  misc_feature: GYAE6OF02HUNB1.38.3.A03.1.454.CMB.1.raw
  modified_base (734)..(734): a, c, t, g, unknown or other
  misc_feature (734)..(734): n is a, c, g, or t
tcagtcgatcacgtcacgaccggtgctcgatttagagagcgtcacagggggcagcgctctcaggacatctccaccatggcctgggctctgctgctcctcaccctcctcactgagggcacacggggtcctcgggacccaatcgtcgccctgtactcgacgccgtcgtccgttccggtcgttcggtcgggtccttccgtgggtacgaggttccggaccgtacctacttcctccgtcgaccgtaccggtacggaaccacggcgtaacgtacggtaactagtttaacggttaaccttaaactaaaccgtagttcggttcctaccggttaaccgtaacctaacctactcccgaacccgacgaaaccccgaaccccggaaaccccctaaaaccttacttaaatttaacgtttaagtaccggtaacggtacgtaacgggtaccggttccgtacccgtttaagggtaccgggtttctaacgttacgttccgttacttcgacgttacgccttacggtacgtccgtagaaccgacccgtccggaccctacgtactactacttccgtcggtcgtcgtttaggacggttggaacgggccgtaggtctaccgtagttatttacggtccgtacctacgtacgtatacggtaacgggtagtacgggtacggggttacgggttaccggaacgggtaaccggaaagtcccgggtacgttaccggtaccggtacgtaccccgagggtacccncgggtacccggtaccccggttacccgtcgggttactaccccggtttaccgtttacccccgttaccccggtcgttaacccggtcggttaccgtaccggtaccgg

SEQ ID NO: 101303 - DNA, 718 bp, Homo sapiens
  misc_feature: GYAE6OF02HPCLS.38.3.A03.1.454.CMB.1.raw
  modified_base (121)..(121): a, c, t, g, unknown or other
  misc_feature (121)..(121): n is a, c, g, or t
  modified_base (181)..(181): a, c, t, g, unknown or other
  misc_feature (181)..(181): n is a, c, g, or t
  modified_base (265)..(265): a, c, t, g, unknown or other
  misc_feature (265)..(265): n is a, c, g, or t
tcagtcgatcacgtcacgaccggtgctcgatttagagagcgtcacagggggcagcgctctcaggacatctccaccatggcctgggctctgctgctcctcaccctcctcactcagggcacgngggtcctgggcccaatctgccctgactcagcctgcctccgtgtctgggtctccgtggacnggtcggtcgccatctccgtgacacgtaggaaccagcaagtgactagttggtaacttactaaccatcgtctctggtaaccaacancaccagaacaacggacccccaaatctaattaacgtttatagtacgtactagtacgtccgccctcgtaacggggtttctcggaatctcttcgtcgaacggtcctacgtaacgtcgtacggaccgtaaaccgaccggtccctaccgtagaacccacgttccgtcgtacgggtccctaccggtacggtttacgggaacgggtaaccggtaggtaccgtacgtaacgttagtttacggtacgtccgtcccgtaactaactaagtaggtaactcgggtaaacggggtttacggggttttacgggacggggtaaccgggtaaaccgtaaacggttaccgtaacccggttacgttaacggggaccaacggtacccgaacgggtcgtaacccgtcccggtacggtccctaccggttcgttcccgttaccccgcccttaccggtactaccgttgtaacccgg

SEQ ID NO: 101304 - DNA, 899 bp, Homo sapiens
  misc_feature: GYAE6OF02HIRO2.38.3.A03.1.454.CMB.1.raw
  modified_base (193)..(193): a, c, t, g, unknown or other
  misc_feature (193)..(193): n is a, c, g, or t
tcagtcgatcacgtcacgaccggtgctcgatttagagagcgtcacagggggcgagcgctctcaggacatctccaccatcggcctgggctctgctgctcctcaccctcctccactcagggcacgagggtcctcgggcccaatctcgccctagacctcagcctgccctccgtcgtctgggtcctccgtggaacgngtcgggtccaccctagtcctccgtgacctacgttacgggaaacccacggtcctaaggtcgaacctaagtttacgggttaaccttttaaacttaaacccgattcggtttacccgttcccttaacgggttaacccaaaacctacttaacccgaaccccaacggaaccgaaaacccggttaacccccccaaaacttacctaaactttaaaacttttaggtaacgtaaccggttaccgaaaggtacggtcccggtacccttacggttaacggggggttttctacgtaaccgttcggtacctttcgtactaacggggtacctttaccggtaaacgttccggttacggtaaccgaaaacccggtacccgggtccccgttaccctaccggtaaacccctacggttaccctccgggttccgggggtaacccttcccgggtaacgggtttacgggaaaccgggtacggtaacgggtccgttaacgaacgtttacgttaagtttccggaccgttcccgtactacgtaagtaacgtagtaccgtaggggttaaccggggtttccgggaggggtaaccggaaacggtaaaggtccgtaaccggtactaccgggtacgacgtacccggaacggtccgaacccggtccccgtcggtacccgttaccgttaccgttcccggtcccccgttacccgtcccgtaccgttacccggagtacccg

SEQ ID NO: 101305 - DNA, 726 bp, Homo sapiens
  misc_feature: GYAE6OF02JZTOJ.38.3.A03.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtcctcctggacngtcggtcnccatcncctgcnctggaaccngctagtgacctagttcgtacttactaaaccnttcgtcctactcggtaccaactcgacaaccgacgaaccgaacggaccccaactctaacttaacgtttaacncggtaaccgttacagtaacggtccgggtacccctaggtacggggttttcacggtaacttccggtacctttcgactaacggtcctacgtaacgttcgttacggaactaccgaccggttcccaccgttacgacctactccgttaccgtgggccctacgtagggtacgtacgggaacgacggtccgtagtacttaagttcgtttacgacgttccctacacgtaacgtcggtaaactcggttaaacggggtttcgtttaccggggaccgggtaacgggtaaccgtaacgggttacgtaccgttaccggaacgttaccgaccgtaccgagttaccccggccgtaccccggtgtaacccggtcgttaccccgttaccgttccccctaacccgttaccgtacgtaccggttacctaaccggg

SEQ ID NO: 101306 - DNA, 735 bp, Homo sapiens
  misc_feature: GYAE6OF02FUY76.38.3.A03.1.454.CMB.1.raw
  modified_base (209)..(209): a, c, t, g, unknown or other
  misc_feature (209)..(209): n is a, c, g, or t
  modified_base (449)..(449): a, c, t, g, unknown or other
  misc_feature (449)..(449): n is a, c, g, or t
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
tcagtcgatcacgtcacgaccggtgctcgatttagagagcgtcacagggggcagcgctctcaggacatctccaccatggcctgggctctgctgctctcacctcctcactcagggcacgagggtctgggcccaatctgaccctgactcacgcttcgccctcgtagtctgggtctccgtagggacaggtccggtacgccctatcctcccgngccgacttgggaacccaggtccaaggttgactagttggttaaccttataaaccctgtagtcctccgttacggtacccaagtaccttacaccccgtaagacgtaaccggacccccctaaaacgttccaattacctaacgtttaacgttaggaccgttaccactcgtaacgtccgggaccctcgtaacggggtttcctaaacgttccgtctactcgtacggtacctcgtaaagtttcggganaaaccccgtcggtaccctacccctagacccctttagttaccggttcgggacccgtttccgacggtttacacggggtacgggaacggtaaacgggcttaaacggtacttttacgttacgaccttcgttaccaggtaacttaaccgnggaacgngtactacgtactaaccctggttacttacgtttcgaaccgttcggaaccgtaaccgtgacccgttcgacctcgaacggtaccccgaacggttaccaaccgtaccgtcaccgtaatcccgtacgttcccctaaccg

SEQ ID NO: 101307 - DNA, 780 bp, Homo sapiens
  misc_feature: GYAE6OF02FUPIF.38.3.A03.1.454.CMB.1.raw
  modified_base (523)..(523): a, c, t, g, unknown or other
  misc_feature (523)..(523): n is a, c, g, or t
tcagtcgatcacgtcacgaccggtgctcgatttagagagcgtcacagggggcagcgctctcaggacatctccaccatggcctgggctctgctgctcctcaccctcctcactcagggcacaggtcctgggcccaatctcgccctgacctcagcctgcctccgtgtctgggtcctcctggacagtcggtcgccatctcatgcacgtcggaccagtcagtcgactagtttaggtaaccttaacaacctattcggttcctccttacggttaaccaactactaccaccacgaacaaccggacccccaaactacctaattaactttatacgtaacgtactaacgtacggtcccgaccgtacggttacggggtttccgtgtacgtccgtctttcacgtacgtccgtaccgaagttcgtacggacgtaaccgaccggtcctacccgtcgaaccctacgtccgtccgacggtcctaccgtaggttacggtaacgggcgacggtccgtagtacttattacgtcgtccgtaccncacgagtacggtaataccgggtacggggttagggtttccgggtaccggggaaagggtaacccgtaaaacgggtcccggtaacccggttacgggtaaccggttaccccgtaacggacccccggtaaccgggtccccgttaccccggtcccccgggtttacccggttaaccccgttacccgtttacccggtttacccccggtttaccccccgttaacccccggttacccccgtttacccggttaaccggttaccccggg

SEQ ID NO: 101308 - DNA, 392 bp, Homo sapiens
  misc_feature: GYAE6OF01BG33M.29.17.B06.1.454.CMB.1.raw
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
  modified_base (357)..(392): a, c, t, g, unknown or other
  misc_feature (357)..(392): n is a, c, g, or t
tcagatagagtactcacgaccggtgctcgatttagtcgatagtgaagggccggttcggatctcttcccgagacaattccagggaatgcactcgtttctgcaaatgaacaacttaagagtcgatgacacggccgtctacttctgtgcgaaagattttggatagcagtagttcgaatcatgatccggttggcttctggggccaggggaaccctggtcattgtcctcctccgcctccaccaagggcccatcggtctcccctgcncctgctccaggncacctcgagngcacagcgccctgggctgcctggtcaaggctacttccatctacactactgagcgggctggcaaggcgnagtagnnnnnnnnnnnnnnnnnnnnnnnnnnnnnnnnnnnn

SEQ ID NO: 101309 - DNA, 365 bp, Homo sapiens
  misc_feature: GYAE6OF01EXWIS.29.17.B06.1.454.CMB.1.raw
  modified_base (356)..(365): a, c, t, g, unknown or other
  misc_feature (356)..(365): n is a, c, g, or t
tcagatagagtactcacgaccggtgctcgatttagtcgatagtgaagggccggttcatctcttcccgagacaattccaggaatgcactgtttctgcaaatgaacaacttaagagtcgatgacacggccgtctacttctgtgcgaaagattttgatagcagtagttcgaatcatgatccggttggcttctggggccagggaaccctggtcattgtctcctccgcctccaccaagggcccatcggtcttccccctggcgccctgctccaggagcacctccgagagcacagcggccctgggctgcctggtcaaggctacttccatctacactactgagcgggctggcaaggcgcatagnnnnnnnnnn

SEQ ID NO: 101310 - DNA, 383 bp, Homo sapiens
  misc_feature: GYAE6OF02I8X8T.29.17.B06.1.454.CMB.1.raw
  modified_base (362)..(383): a, c, t, g, unknown or other
  misc_feature (362)..(383): n is a, c, g, or t
tcagatagagtactcacgaccggtgctcgatttagtcgatagtgaagggccggttcgatctcttcccgagacaattccagggaatgcactgtttctgcaaatgaacaacttaagagtcgatgacacggccgtctacttctgtgcgaaagattttggatagcagtagttcgaatcatgatccggttggcttctggggccaggggaaccctggtcattgtctcctccgcctccaccaagggcccatcggtcttccccctggcgccctgctccaggagcacctccgagagcacagcgccctgggctgcctggtcaaggactacttccatctacactactgagcgggctggccaaggcgcagtagnnnnnnnnnnnnnnnnnnnnnn

SEQ ID NO: 101311 - DNA, 627 bp, Homo sapiens
  misc_feature: GYAE6OF01AXVF1.43.16.B05.1.454.CMB.1.raw
tcagtgtgagtagtcacgaccggtgctcgatttagagctcacgtatttgggtttgggctgacgcgtcgggttttccctcgttgctacttttaaagaggtgtaccagtgtcagggttgtcctacatgggtaggagtcgtgggggacggcgtggtccgacgccgtcggggcgtccctgagactctcctggtgggacggtcctcgtgggttcgaccctacaacttaaacgatcggatcgcactgggtccgcaggctccagggcaaggggctggagtgggtgacacaaagatcatccgtgactccggacggcgaagtaaatacgtacgcgagactccgtaaaggccggttcaccgatcctaccacgggaccaacttccaagaacacactgtattgacaaatggacagcctagacgaaacgtacgaggacctcggctaagtgaatttagttgtgcgagagagtggactggactgattctgtttcggagagtatgacgtacgtggggccgagggtacccgtggtccgaccggtcgaccgtccacggccctaccgaccgaacgggccccacgttcccgtcccgtcccccgtaggcccgaccccgtcgtccctcccgacggccgccgtaccccgg

SEQ ID NO: 101312 - DNA, 622 bp, Homo sapiens
  misc_feature: GYAE6OF02HIFE9.43.16.B05.1.454.CMB.1.raw
  modified_base (270)..(270): a, c, t, g, unknown or other
  misc_feature (270)..(270): n is a, c, g, or t
tcagtgtgagtagtcacgaccggtgctcgatttagagctcacgtattggggtttcgggctgagcctgggttttcctcgttgctcttttaagaggtgtccagtgtcaggtgcacatggtagagtcctgggggaggcggtggtccagacctggggtcgtccctgagactctcctgtggagtctctgggttcaccctcaataaacagtggaaagtcgacgacgtagggtcccgaccaggctccgaggcaaggggctggagtgggtgcacaacntcatctgatggacgcaataaatactacggcaggactaccggtaaagggcccggttacaccgatcctccgagggacaattccaaagaacacactagtatttgacaaatggacagcctagacgaagtgaggactcggctatgtatttagttggtgcgagagatagcgtggacttggtattctcggtttcggagggtagtattgacgtacgtggggaccgacgggtaacccgtcggtacgtaccgtcgtccctcacgtccctccacccgaaccgggccctaacggtcccggttacccttcccccggtacggcccgtcccgtcgcccgttcccggacggtaccgccgtaaccccgg

SEQ ID NO: 101313 - DNA, 551 bp, Homo sapiens
  misc_feature: GYAE6OF01AX68D.51.10.A10.1.454.CMB.1.raw
  modified_base (481)..(481): a, c, t, g, unknown or other
  misc_feature (481)..(481): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccggcagagggtcaccatctcctgttctggaagcaactccaacatcggaagttatactgcagactggtaccagcaactccaggactccggcccccaaactcctcactctatactactaatcaacgggccacgacgggtccctagaccgattcctccggctccaagtctggcacctcacgcctccctggccatcgagtcggtcctccagtctgaggatgagctacaacttacttctgtgctatcagtggatagactagtttagaagttcggtcggttgttaccgggngggtaacgggtacctaacgtcggacccgttcgttacgtactacgacccgaaggcctccggcccccgtcgg

SEQ ID NO: 101314 - DNA, 549 bp, Homo sapiens
  misc_feature: GYAE6OF01CRZYK.51.10.A10.1.454.CMB.1.raw
  modified_base (450)..(450): a, c, t, g, unknown or other
  misc_feature (450)..(450): n is a, c, g, or t
tcagcgatcgtatacacgaccggtgctcgatttagcgtcgatctcaggggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccgggcagagggtcaccatctcctgttctggaagcaactccaacatcggaagttatactgcagactggtaccagcaacctcccaggactccggacccccaaactcctcactctatactactaatcgaacgggccacgacggggtccctagaccgtattccgtccggctccaagtcgtggccacctcacgccctcccgtggcccatcagtcggtctccgagtctggaggatgagctacaattcttntgtgacatcagtgggatgactagtttgaagttcggtcggttggttcgggcgggacgggacccaaagtcgtaccgttcttacgcacgcccgaaggtcccg

SEQ ID NO: 101315 - DNA, 603 bp, Homo sapiens
  misc_feature: GYAE6OF01CO0I1.51.10.A10.1.454.CMB.1.raw
  modified_base (241)..(241): a, c, t, g, unknown or other
  misc_feature (241)..(241): n is a, c, g, or t
  modified_base (471)..(471): a, c, t, g, unknown or other
  misc_feature (471)..(471): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccgggcagagggtcaccatctcctgttctggaagcaactccaaacntcggaagttatactgcagactggtaccagcaactcccaggactccggacccccaaactcctcactctactactaactaactcgaacgggccacgacggggtccctaggaccgtattccgtccggcctaccgaagtctcggacctaccctcacgccctcccgtcggcccatctacggtcggtctccgagtctaggaggtatcggacggcttacgtaacttacttcgtgtcncctattccagttgggactggtacttaggtttagagttcgggttccgggtggttccgggacgggtacggaccctaacgtcggtacccgttcgttagtccacggtacccgaaggtcctccggtcccccgtacgg

SEQ ID NO: 101316 - DNA, 715 bp, Homo sapiens
  misc_feature: GYAE6OF01EE3UX.51.10.A10.1.454.CMB.1.raw
tcagcgatcgtatacacgaccggtgctcgatttagcgtcgatctcaggggggggaagctcagcttcagctgtgggtagagaagacaggactcaggacaatctccagcatggccagcttccctctcctcctcaccctcctcactcactgtgcagggtcctgggcccaatctgtgctgactcagcccaccctcagcgtcgtcgggacccccgggcaggagggtccaccatctcctgttctggaagcaactccaacatcggaagttatactgcagactgtaccagcaacctcccgaggactccggacccccaaactcctacatctatactactaactcgaacgggccacgacggggtcctgaccgtcttccgccggctaccgtaagtcgtcggccctacctccacgtcccttcccgtggaccctagtccgaggttcggtcctcctacggtctaggacggtagttcggacggtccttaactaaactttaccgtttccgttaggtacgacctaacgttaccgtaaggttacggggtaacttacgggtaaccgtttaagggtttttacggaaacgggttttccgggggttacccggggtttacggggtttacccgggggaccgggggtaaaccgggtaaaccccgttaaaaccggttccggtaaccccccggttttactttaaccgggaccgtaacccggtaccccggtaacggtcccccg

SEQ ID NO: 101317 - DNA, 572 bp, Homo sapiens
  misc_feature: GYAE6OF01BECKW.51.10.A10.1.454.CMB.1.raw
  modified_base (199)..(199): a, c, t, g, unknown or other
  misc_feature (199)..(199): n is a, c, g, or t
  modified_base (405)..(405): a, c, t, g, unknown or other
  misc_feature (405)..(405): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccggnagagggtcaccatctcctgttctggaagcaactccaacatcggaagttatactgcagactggtaccagcaactcccaggatccggcccccaaactcctcatctatactactaatcaacgggccacgagggtccctgaccgattctccggctccaagtctggcacctcacgcctccctggccatcagtggtcctccgagtctgaggntgaggtctcaatacttctgtcgctatcgagtgggatgtactagtttgaacgttgggtccgggtggttcgggacgggtacgggaacccgtaaacgttcggtaacccggttccgttaaggtccgtaacggtaccccgaaagggtcccgtcccgtccccccggttaccgg

SEQ ID NO: 101318 - DNA, 573 bp, Homo sapiens
  misc_feature: GYAE6OF01CYR72.51.10.A10.1.454.CMB.1.raw
tcagcgatcgtatacacgaccggtgctcgatttagcgtcgatctcagggggagcttcagctgtgggtagagaagacaggactcaggacaatctccagcatggccagcttccctctcctcctcaccctcctcactcactgtgcagggtcctgggcccaatctgtgctgactcagcccaccctcagcgtctcgggacccccgggcaggagggtcaccatctcctgttctggaagcaactccaacatacggaagttatactgcagactggtaccagacaactcccgaggactcccggacccccaaactcctacactacctaataactactaactcgaaccggccacgtacggggtccctgaccgattccgccggctaccaagtccgtcggcctacctcacgtccctccgtcgccatcgagtcgtcctcgtagtcgtggacgtatgacggtctactaacttacttgtcgtgctagtcgaggtggatgaacgttagttagacgttggttcggtggtccgggaggacggtacaacgtcgtaccgtcgttagctacgaccaaggcctcggtccccgtcgg

SEQ ID NO: 101319 - DNA, 856 bp, Homo sapiens
  misc_feature: GYAE6OF01CQ8O8.51.10.A10.1.454.CMB.1.raw
  modified_base (208)..(208): a, c, t, g, unknown or other
  misc_feature (208)..(208): n is a, c, g, or t
  modified_base (813)..(813): a, c, t, g, unknown or other
  misc_feature (813)..(813): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcgagggtccgtcgggacccaatctgtgctgactcacgcccacctcacgcgtcgtccggggaccccggngacggacggtccacctacttccttcgttcgtttacgagggaacgacctaaacctaccaaactacgtacgggtaatttaactaccgtgaccgtaagtaccgtacggtaaccaacggacctaacccgtacccgaacgggtaccgtacccccggaaccccccctaaaccttccctacctaacgttaaccttaaaccgtttaaacctttaaacctaaaccgttaacccggaaacccggggtacccgaaaccgggtaccgggggttacccctacggtaacccgtacgtttccccggtacccgggtaccctaaccgtaacgttccgtaccggacctacccgtcgaccggtccccttccgtcggacctacgttccgtaggttccgtacctaccgtagtccgtaggaacggtacgtcggtaacggtaccttaacgtaaacgtttcgtttcggttacgtcgtaacctaaggttcgtaagggttacggggtaactacggttaaacgttgggttttaacgggacggttccgggggtttacggttacggggtccggggtaacgggtaaccggtaaacccgttaacgggtacccggttaccccgttacgttaccgganaccccggtaacgtacggttcccgtcccggtacccccgtttcgg

SEQ ID NO: 101320 - DNA, 970 bp, Homo sapiens
  misc_feature: GYAE6OF01D0F8R.51.10.A10.1.454.CMB.1.raw
  modified_base (207)..(207): a, c, t, g, unknown or other
  misc_feature (207)..(207): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcacgcccaccctcacgccgtcgtccggggacccccggnacggacgggtccacctatccttcccgttgttccgtagggaaacgcctaaaccttacccaaacgtagttaccgggtaaagttttaactaaccgtggaccgaaggtaccgttacgggtaacccaacggaccctaaacccgttccccgaagggtaaccttaccccgggaacccccctaaaaccgttcccttaactacctaccttaaacttaaccttaaccgtaaaaccgtacccggaaaacccgggtccccgtaaaccggtaacccggggggtttccccctaacggtaaaccccggttaaccgttttccccggtacccggggttacccttaaaccccggtaaacgggtttcccggtaccgggtaacccctaaccccgttaccggaacccggttcccccttcccgggtaccggtaccctaagttaccggtaaccggtttccggttaccgtttacccgtacggtttacggtacgggtaaccgggtagttacgggaaccgggttacccgtaacctaaaccggttttacccgtttaccggttacgggtacgttaaccccgttagttaacccggtaagggttaccgggttaacgttaccggtaaacccggtttggttttaacggaccgggtttccggggttacccggggtttacgggtacccggggaccgggtaaaccgggttaccgtaaaccggttaccggtaccccggtttacgacccgtacccggtacgacccggtaacggtccccggttccgtcccccggttaccgg

SEQ ID NO: 101321 - DNA, 838 bp, Homo sapiens
  misc_feature: GYAE6OF01ECA5W.51.10.A10.1.454.CMB.1.raw
  modified_base (207)..(207): a, c, t, g, unknown or other
  misc_feature (207)..(207): n is a, c, g, or t
tcagcgatcgtatacacgaccggtgctcgatttagcgtcgatctcaggggagcttcagctgtgggtagagaagacaggactcaggacaatctccagcatggccagccttccctctcctcctcaccctcctcactcactgtgcagggtcctgggcccaatctgtgctgactcacgcccaccctcagccgtcgtccggggacccccggngaggacggtcaccattcctcctgttcgtaggaacgcctaacctccaaatacgtacggtaagttactacgtgacaacgtaccgtacggtaaccacgacctaacccgtacccgaacggaccgtaccccggaaccccctaaacctcctactacttactaactacctaactaactaccgaaccgggcccaaccggtaccggggtccctacggaaccgtactttcccgtaccgggtcctaccgtaacgtccgtacggtaccctaaccgtccgaccgtccccgtccgtccggacctacgttaccgtacgggttccggttacctaccgtacggttcgtacgggtaacggtagtaccgggtaacgtcccttaacgttaaacgtttaccgtttccgtaggttacgtacctaacgttcgtaacgggttagggaacgttacggttaaccggtttagggtttaacggtaccgggtttccgggggttccgggtttaccggggttaccgggggaaccgggttaaaccgggtaaacccgtaaaccgggttccgggttaaccccggtttaccggttaaccggacccgtaacccgggtacccggtaaacccgggttcccgtaccccccgggttaccccgttacccggg

SEQ ID NO: 101322 - DNA, 530 bp, Homo sapiens
  misc_feature: GYAE6OF01BY0D2.51.10.A10.1.454.CMB.1.raw
  modified_base (200)..(200): a, c, t, g, unknown or other
  misc_feature (200)..(200): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggnagagggtcaccatctcctgttctggaagcaactccaacatcggaagttatactgcagactggtaccagcaactcccaaggactccggacccccaaactcctcatctatactactaatcaacgggccacgacgggtccctgaccgtattccgtccggctccaagtctggccacctcacgcctccctggccatcagtcgtctccagtctgagatgagctcaatcttctgtgcatcagtgggatgactagttgagtggtccggttgttcgggcgggacggacctaagtcggacccgtcttaggtcacggacccaaggcctccgcccccgtcgg

SEQ ID NO: 101323 - DNA, 740 bp, Homo sapiens
  misc_feature: GYAE6OF01DA3RY.51.10.A10.1.454.CMB.1.raw
  modified_base (212)..(212): a, c, t, g, unknown or other
  misc_feature (212)..(212): n is a, c, g, or t
tcagcgatcgtatacacgaccggtgctcgatttagcgtcgatctcagggggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtcgtcgggacccccggnagagggtcaccatctcctgttctaggagcaactccaacatcggaagttatactgacagactcggtaccagaccaactcccaaggactccggacccccaaactcctacactacttaactaacctactaacgtacgaaccgggccacggacggggtccctacgacccgtacttccgtcccggacctaccgaagttccgtcgggtaccaacccgtcgtaccgtcccccttcccggtacggccctaacgttccgtacgttccgggtaccttcccgacggttcgtacggagggtaacgtacgggacgtaccgttaacctaactttaaccgtttcgtcgtcggtactaacgttcgtaggtacgggtagttacgggtacttagggttttaacgtaacgggttccgggttccggggttacgggtttacccgggggagggtaaaccggggtaaccctaaaccgggttaccggttaaccccggtttaccgtttaaacgtcccggtaacccggtaccccggtaacgggttaccccccgg

SEQ ID NO: 101324 - DNA, 683 bp, Homo sapiens
  misc_feature: GYAE6OF01BZ5LB.51.10.A10.1.454.CMB.1.raw
  modified_base (313)..(313): a, c, t, g, unknown or other
  misc_feature (313)..(313): n is a, c, g, or t
tcagcgatcgtatacacgaccggtgctcgatttagcgtcgatctcaggggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtcgtcgggacccccgggcaggagggtcaccatcctcctgttctggaagcaactccaacatcggaagttatactgcagactggtaccagcaactcccaggactccggccccaaactcctnactctatactactaatcaacgggccacgaggggtccctagaccgtattcccgtccgggctacccgtaagtccgtcggacctacccctcgaaccgtccccttcccgtacggccctaattccgaacggttcggttacctcccgtacgtcctaggacgggtatagggacgtaccgtacgtaaacgttacctttccgtggtacgacctagttacgaggttaggggtatcggtaaccgttaggtttacggtaaggttcgggttaccggggtttgggttacccggggtacggggaacgggtaaacccctaacggttcggtaaccccggtttaccctttacggacccgtaaccgaccccggtaaccggttcccccgg

SEQ ID NO: 101325 - DNA, 832 bp, Homo sapiens
  misc_feature: GYAE6OF01ARF2W.51.10.A10.1.454.CMB.1.raw
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtcgtcgggacccccgggcaggagggtcaccatcctcctgttctggaacgcaactccaacagtacggaagttatactgacagacgtggtaccagacaacctccgaggactcccggacccccaaacgttccctacactactataacctactaatccgaacggccacgacgggtccctagaccgtacttccgtccgctaccgaagtccgtcggaccacctcacgtccctcccgtcggacctacgtcgacggttcggtcctaccgtacgttcgtaggaacgggtacgtacggacggttaccgtaacttaaaccgtttaccgtttaaccgttcggttacgtacccgttaacgttaccgtaagggttacgggggtaacttaacgggttaaccgtttaacgggtttttaacgggtaaacgggttttccgggggttaccccggggtttacgggggttttaccccggggggaaccgggggtaaaccgggggtaaacccccttaaaaccggggtttaccccgggtttaaaccccccggttttacccggttttaaacccgggttaaccccggttaaccccgggttaacccccgggttaaaacggggttccccccgtttccccccggggttaaccccccccgggttttaacccccggggg

SEQ ID NO: 101326 - DNA, 723 bp, Homo sapiens
  misc_feature: GYAE6OF01DHQ54.51.10.A10.1.454.CMB.1.raw
  modified_base (180)..(180): a, c, t, g, unknown or other
  misc_feature (180)..(180): n is a, c, g, or t
  modified_base (201)..(201): a, c, t, g, unknown or other
  misc_feature (201)..(201): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctnagcgtctcgggacccccgggnagagggtcaccatctcctgttctggagcaactccaacatcggaagttatactgcagactggtaccagcaactccaggactccggacccccaaactcctcactctactactactaatcaacggccacgacgggtccctagaccgtacttccgtccggctaccgaacgttccgtcggacctacccgttccaccggtcccttccccgttggaccctaacgttcaacgggtttcggtccctccgtaacggttcccgttaggaacgggtactacgggacggtccttacgtaaacgtttaccgtttacgttcggttacgtcctaagttcccgtaaggttacggggtacttacggtaaccgttaggttttacggaacggtttcggggttccgggtttacgggttccggggtaccggggtaacggggtaacccctaaacgggttacccggtaacccggtttaccgtttaacgtaccgtaaccggtaccccgtaaacgggtcccgttacccggtcccccggtttacccggg

SEQ ID NO: 101327 - DNA, 628 bp, Homo sapiens
  misc_feature: GYAE6OF01BXWDS.51.10.A10.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (383)..(383): a, c, t, g, unknown or other
  misc_feature (383)..(383): n is a, c, g, or t
tcagcgatcgtatacacgaccggtgctcgatttagcgtcgatctcaggggggggaagctcagcttcagctgtgggtagagaagacaggactcaggacaatctccagcatggccagcttccctctcctcctcaccctcctcactcactgtgcagggtcctgggacccaatctgtgctgactcagccacctcagcgtcgcgggaccccggcagaggcaccatctctgtctaggancaactcaanatcgtaagttatacngcagacgtgtacagcaactccaggctccgacccaactcctacatactatactactatcgaacggccacgacgggtcctagactagtccgtacgctaccgagtcgtcgctacgtcacgtccctccgnggccctaatcgtaaggtcgttctcgagtcgtaggacgtattcggagtctaacgtaacgttactttccgagtgtaccacgttacgtagtgggtaactaccgaaggttaggttttacgaacgttggggttaccccggttaggggttacccgggacggggaaaacgggtacccctaaacgggtttaccggaccccgtttaaaccggtttacggaacccttaaccgggaaccccggagttaaccccggg

SEQ ID NO: 101328 - DNA, 675 bp, Homo sapiens
  misc_feature: GYAE6OF01AT3CL.51.10.A10.1.454.CMB.1.raw
  modified_base (331)..(331): a, c, t, g, unknown or other
  misc_feature (331)..(331): n is a, c, g, or t
tcagcgatcgtatacacgaccggtgctcgatttagcgtcgatctcaggggggggaagctcagcttcagctgtgggtagagaagacaggactcaggacaatctccagcatggccagcttccctctcctcctcaccctcctcactcactgtgcagggtcctgggcccaatctgtgctgactcacgccaccctcagcgtcgtcggggacccccgggcagagggtccaccatctcctgttctggagcactccaacatacggaattatactgacagactggtaccagcaactccgaggactccgaccccaactcctacactactactactactaanccgaacggccacgcgggtcctcgacctattccgtccgctaccagtcgtgacctacctcgacgtccctccgcggacctagtccgtacggttcggttccctaccgtacgttccgtaggacgggtacgtcggacggtcctaacgtaaactttcgttacgtcggtacaccgttacgtacgtaggtacgggtaacttaggtaacgttaaggtttacgggaacgggttttccggggttaccggggtttcgggtttacccgggggaacggggtaaacccgggtaacccgttaacggtaccgttaccccggttcgttaacgacccggacggtacccggacggttacccccgg

SEQ ID NO: 101329 - DNA, 688 bp, Homo sapiens
  misc_feature: GYAE6OF01B3ZR1.51.10.A10.1.454.CMB.1.raw
  modified_base (200)..(200): a, c, t, g, unknown or other
  misc_feature (200)..(200): n is a, c, g, or t
  modified_base (353)..(353): a, c, t, g, unknown or other
  misc_feature (353)..(353): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcacgccaccctcagcgtctcgggaccccggnagaggtcacatctctgttctggaagcaactccaacatacggaattactactgcagtactagtaccagccaactcccgagactccggaccccctaactcctcactactactaacctaactaactacgaacggaccacgcgggtccacgaccgtntccgccgactaccgacgtcgtcggccactcgaccgtccctcccgtacggcctatccgtacggttcgttcctaccgaggttccgtaggtaacggtagtacggacgtaccttaacgtaacctttaccgttcttggtacgtactaagttacgagttacgggattacggtaacgtttagtttacggtaacggttcgggttccgggttagggttaccggggaaccggggtaaaccgggaacccgttaaacggtccggttaaccccggttaccgtttaaaccgccgtaaacccggtcccggtaaaccggtcccgttacccccggtcccccggtttacccgg

SEQ ID NO: 101330 - DNA, 806 bp, Homo sapiens
  misc_feature: GYAE6OF01A5TY7.51.10.A10.1.454.CMB.1.raw
  modified_base (228)..(228): a, c, t, g, unknown or other
  misc_feature (228)..(228): n is a, c, g, or t
tcagcgatcgtatacacgaccggtgctcgatttagcgtcgatctcgaggggggggaagctcagcttcagctgtgggtagagaagacaggactcaggacaatctccagcatggccagtcttccctctcctcctcaccctctcactcactgtgcagggtcctggaccctaatctgtcgctagacctcacgcccaccctcgacgtccgtccggtcccggggaacccccggngaacggtaccgggtaccaacccgtacttcccttcgttcggttaccgtacggtaaacgaccctaaaccgtacctaaacgtacggttaaccggtaagtttaacctacgtcgactacgtacgtacggtaccaacgtaccaaccgtcccgaaggtaccgtaccccggtaaccccctaaactccgtacacgttaccttaactaccttaaactacgtaacccgaaccggtccgtaacggtacccggggtcctacggtaaccgtacgtttccccgaccggtcctaacgtacggtcccgttacggacccctaccgtaccgtacccgttcccccgtaccgtacccggtcctaccgttcggtaccggttaccggttcctaacccggtacgtacgtagggacgtaggtacgtaccggtactaccgttaacgttacgtttcgtgttaccaacggttacgtacgtgtaggtactacggttcgttaaggtttcgacggttccgggtcgggttacggtaccgggtacgggaaccgtaacgtaccgttacccggtaccgttcggtacgtaccggacctaccggacgttccccgg

SEQ ID NO: 101331 - DNA, 765 bp, Homo sapiens
  misc_feature: GYAE6OF01CJCU7.51.10.A10.1.454.CMB.1.raw
  modified_base (237)..(237): a, c, t, g, unknown or other
  misc_feature (237)..(237): n is a, c, g, or t
  modified_base (542)..(542): a, c, t, g, unknown or other
  misc_feature (542)..(542): n is a, c, g, or t
  modified_base (636)..(636): a, c, t, g, unknown or other
  misc_feature (636)..(636): n is a, c, g, or t
tcagcgatcgtatacacgaccggtgctcgatttagcgtcgatctcgaggggggggaagctcagcttcagctgtgggtagagaagacaggactcaggacaatcctccagcatggccagcttccctctcctcctccacccctcctcactcactgtgcgacgggttccgtcgggaccctaatcgtgtcgctcgactcacgccctaccctgacgtccgtccggtaccgggacccccggganacgggtacggtaccaacctctccttccgttcgtttcgtagggaacgacctaacctaccgaaacgtagtttaccgggtaaatttaacgtacgtacgacgtaacggtacgttacggaccgtaacgacctaacccgtccggaacggtaccgtaccccggtacccccctaaaacttcccctaactacgttaccttaacttaaccgttaactaacctaccgggaaccggaacccgtacggtacccggggttcctacgtaccggttactttcccggaccgtctaacctacggtcgtacgcccgtacctacnccgtaccctccgtcgacctacgtcgtacgtccgtactcgtacgtaccgtggacgtacggttacgacggtcttaactactttacttgtcggtacncgtacgtacgtaggttcgtacgttagtacgttaaggttcgtagggttccggtacgggttcgggtaccggaaggtaccggtaacttaccgtacggtaccgttacgtaccgagaccgtccggacgtcccgg

SEQ ID NO: 101332 - DNA, 773 bp, Homo sapiens
  misc_feature: GYAE6OF01BQG5B.51.10.A10.1.454.CMB.1.raw
  modified_base (199)..(199): a, c, t, g, unknown or other
  misc_feature (199)..(199): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcaggtcctgggcccaatctgtgctgactcagccacctcagcgtcgtcgggacccccggnagacggtcaccgatcctcctgttctggtaagccaactccaactatacggtaagtttactactgactagactcgtaccagaccaacctccgaggaccgtcccgaacccccaactcctacgtacttctaacgtacctactaacgtaccgaaccggacctacggtaccggtccctcggaaccgttacgtcccgtcgtacctaccgtacgtccgacgacctaccgtccgtaccggtccctcccgtcgtccctaagtccgtacggttcgttcccgaccgttacgtcgtacggtaggtacgtaacggacggttacctaacgttaaacttacccggtttcgtacgtacgggactttaacgtcggtaacggttacgggtaacgttacccggtaagtttacgttttaacggggaaccgtttcgggggttaccgggttaccgggttaccgggaaccggggttaacccggaaacccgttaaacggttccccgggttaaaccgtttaaccccggttaagaccccggtaaccccgggtaacccggaccggtttaccccggttcccccgaccccccggtttaaccggg

SEQ ID NO: 101333 - DNA, 877 bp, Homo sapiens
  misc_feature: GYAE6OF01CU2EF.51.10.A10.1.454.CMB.1.raw
  modified_base (239)..(239): a, c, t, g, unknown or other
  misc_feature (239)..(239): n is a, c, g, or t
  modified_base (682)..(682): a, c, t, g, unknown or other
  misc_feature (682)..(682): n is a, c, g, or t
tcagcgatcgtatacacgaccggtgctcgatttagcgtcgatctcgaggggggggaagctcagcttcagctggtgggtagagaagacaggactcaggacaatctccagcatggccagcttccctctcctcctcaccctcctcactcactgtgcgtacgggtccgtcggcccaattctggtcgtcttcgacctcacggaccctaccctagacgtccggtccggtcccggggacccccggngacgggtacggtacctaccgtaacttcccgttccgttacggttaccgtacggaaaccgtacctaaccgttacccaaacgtaacggttaacgggtaaacgtttactaacgttacggaaccgtaacggtaaccgtacgggtaaccgaactaaccccgtaacccgttccgaacggtttacccgaccccggaacccctaaccgttccacttacttaacgttactaaccgtaacttaacgaaccggaaccggacctacggcccggttcgtaacgaccgttcttcccgtcccgtacgtcctaacgttcgccgtaacccgtccgtaaccgcccgtccctcccggtacgtaccttacttccggtaacggttccgttacccgtacggtcggttacgtacgggtaacgtcgttacggtaccgtaccttaccgttaaacgtttcgtacggtttntaccgggaaacttacgtaccgggagttacgggtaagttacgttccgtttaaggtacgggttacggtttaccgggttaccggggttacggttaacgggggaccgggttaaacccgggtaacggtaaccccgtttaccgggacccgtttaccggttacccgaacgtaacccgggtacccggtaccggttaacccccg

SEQ ID NO: 101334 - DNA, 550 bp, Homo sapiens
  misc_feature: GYAE6OF02GKENS.51.10.A10.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagcgatcgtatacacgaccggtgctcgatttagcgtcgatctcagggggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccgggcaggagggtcaccatctcctgttctggaagcaactccaacatcggaagttatactgcagactggtaccagcaactcccgaggactccggacccccaaactcctcatctatactactaatcaacggccacgacggggtccctagaccgattcctccggctccaagtctggccacctcacgccctcccgtggcccatcagtcggtctccagtcngaggntgagctacaatcttctgtgcatcagtgggatgactagtttagagttcgggtccggtggttccgggacggtaacgggaacctaacgtcggtacccgttcgttagtccacggacccgaggtccc

SEQ ID NO: 101335 - DNA, 652 bp, Homo sapiens
  misc_feature: GYAE6OF02HYD7F.51.10.A10.1.454.CMB.1.raw
  modified_base (486)..(486): a, c, t, g, unknown or other
  misc_feature (486)..(486): n is a, c, g, or t
tcagcgatcgtatacacgaccggtgctcgatttagcgtcgatctcagggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtcgtcgggaccccccgggaggacgggtccacctatcctccgttgttctaggaacgcaacctaccaaactacgtaacggtaagttaactactgacagtacgtacggtaccagaccaaccacccgaggactcccgaaccccaactcctacactctataactaactaatacgaaccggccacgtacggtccctagacgtacttccgtccgactaccaacgtcgtcgaccaccgtccaccgtccctcccgtcgacctactcgtagtcgtcctccgacgttcgtaggagtagtacggngtccttaactaactacctttcgtgtacgactactacgagtacggatacgtagtagtttacgaaggttcgggtccggttaggtccgggtaccgggaacgggtaaccctaaaccggtccggttacccgttaccggttaacgtacccggacggtaccccgaaggtcccg

SEQ ID NO: 101336 - DNA, 572 bp, Homo sapiens
  misc_feature: GYAE6OF02GRS14.51.10.A10.1.454.CMB.1.raw
  modified_base (214)..(214): a, c, t, g, unknown or other
  misc_feature (214)..(214): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagcgatcgtatacacgaccggtgctcgatttagcgtcgatctcagggggggggaagctcagcttcagctgtgggtagagaagacaggactcaggacaatctccagcatggccagcttccctctcctcctcaccctcctcactcactgtgcagggtcctgggcccaatctgtgctgactcagccaccctcagcgtcgtcgggaccccccgggnaggagggtcaccatctcctgttctggaagcaactccaacatcggaagttatactgcagactggtaccagccaactcccaggactccggacccccaaactcctcatctatactactaatcaacgggccacgacggggtccctgaccgtattcctccggctaccaagtctggccacctcacgccctccnggccatcgagtcgtctcagtctgagtntgagtctacaacttacttctgtgactatcgtagtgggatggacttaggtttagaggttcgggtccggtggttcgggaccgggaacgggaaccctaaacgttcggtacccgttccttaacggtaccgacggtacccgaggtcccg

SEQ ID NO: 101337 - DNA, 594 bp, Homo sapiens
  misc_feature: GYAE6OF02JFO1T.51.10.A10.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccgggnagagggtcaccatctcctgttctggaancaactccaacatcggaagttatactgcagactggtaccagcaactcccaggactccggaccccccaaatcctacatctaatactactaatccaacgggccacacggggtccctgaccgtattctaccggctacccgaagtctcggccacctcacgccctccctggcccatccgagtcggtctccgagtctgaggatgacggctcaaagttaccttctggtcgcaatcgaagttgggattggaactaggttttgaacttgggttaccgggttgttacgggacgggaacgggtaaccctaaagttcggacccgttacttacggtcgtaaccgcccgtaaagggcccttacccggccccccgttacgg

SEQ ID NO: 101338 - DNA, 608 bp, Homo sapiens
  misc_feature: GYAE6OF02GGVRI.51.10.A10.1.454.CMB.1.raw
  modified_base (199)..(199): a, c, t, g, unknown or other
  misc_feature (199)..(199): n is a, c, g, or t
  modified_base (380)..(380): a, c, t, g, unknown or other
  misc_feature (380)..(380): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccggnagagggtcaccatctcctgttctggaagcaactccaacatcggaagttatactgcagactggtaccagcaactcccaggatcggcccccaaactcctcatctatactactaactcaaccgggccacgacggggtccctgaccgtattctccggctccaagtctggcacctcacgcctcccnggccatcagtgtctccagtctgaggatgacggctacactacttctgtgtacatcagtgggtatgtacgtagttttgaaacgttcgggttccgggttaggtttccgggacggggtaacggggtaaacccgtaaaaccgttccgggtaaccccggtttacccgtttaacggtaccgtaaccggaccccggtaaagggtcccttacccgggtacccccccgtttaccgggg

SEQ ID NO: 101339 - DNA, 596 bp, Homo sapiens
  misc_feature: GYAE6OF02IK5PF.51.10.A10.1.454.CMB.1.raw
tcagcgatcgtatacacgaccggtgctcgatttagcgtcgatctcagggggagcttcagctgtgggtagagaagacaggactcaggacaatctccagcatggccagcttccctctcctcctcaccctcctcactcactgtgcagggtcctgggcccaatctgtgctgactcagccaccctcagcgtctcgggacccccggcaggagggtcaccatctcctgttctggaagcaactccaacatcggaagttatactgcagactggtaccagcaactcccaggactccggaccccaaactcctacatctatactactaatcaacggccaacgacggggtccctgaccgattccgtccggctaccaagtcgtcggccacctcacgtccctcccgtggccatcagtcgtctccgtagtctgagatggacggtctactaacttacttctgtcgactatcgagtagggtatcggtaacttagtttaggaaggttcgggttccggttcgggttccgggacgggtacgggaacctaaaccgttcggtaacccgttaccgtttagtaccgacggtacccgaaggtccctccggtcccccgtccgg

SEQ ID NO: 101340 - DNA, 667 bp, Homo sapiens
  misc_feature: GYAE6OF02I7YOM.51.10.A10.1.454.CMB.1.raw
  modified_base (242)..(242): a, c, t, g, unknown or other
  misc_feature (242)..(242): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcgagggtcctgggcccaatctgtgctgactcagcccaccctcagccgtcgtcggggacccccgggcaggagggtccaccactcctccttgttctagggaacnccaacctccaaacagtaccggaagttatactggcagacgtggtaccagccaactccgaggacgtcccggaccccaaactcctacactactatacctactaactaccgaacggtccacgtacgggtccctagacctacttccgaccgctaccaagtctcggcctacctcgaaccgtccctaccgtcgacctataccgagttcggtcctaccgacgtctggaggtacgtcgaacggtctacttaaacttcgttactcggtcacgtaactcgtaaacggtgggtaactacgtacgttaggtttaagtacggttacgggtttcgggttcggttcggggaacggtacgggtaaaccgtaaccgtcggttaaccgttaccgttacgtaccgaccggtaccggtaacggtcccgttaccgtcccccgtacgg

SEQ ID NO: 101341 - DNA, 843 bp, Homo sapiens
  misc_feature: GYAE6OF02HALUV.51.10.A10.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagcgatcgtatacacgaccggtgctcgatttagcgtcgatctcagggggggggaagctcagcttcagctgtgggtagagaagacaggactcaggacaatctccagcatggccagcttccctctcctcctcaccctcctcactcactgtgcagggtcctgggcccaatctgtgctgactcacgccaccctcagcgtcgtcggggacccccggnagacgggtcaccatctccttgttcgnggaagccaacctccaactagtacggtaagttactactgcacgactggtaacccagacctaacctcccgaaggtacctacccggaccccccaaaacttccctactaacttaccttaaactaaccttaacgttaaaccgttaccggaaaacccggggtacccgaaccgggtaccgggggttaccccgtacggtaaaccccgtaacgttttccccggtaccccgggtacccttaaccccgtaaacgggtttcccgtaccgggtacccctaacccgttaccgaaccgggttccccttaccccgtcgggtaccctaacgtcgtacggttccggttacccgtaccgtacggtccttagggacgaacgttcgggacggtccttaacgtaaatttaccgttcgtcgttacgacctacgtacgtaggttacgggtaacttcggttaaaccgttaggttttacggtaaccgggtttccggggtttaccggggtttcgggttaccgggggaaccggggtaaccggggtaaacccttaaacccggttcggttaaccccggttttaccggtttaacgggtacccgaaacccggtacccggaaccgggttccccggg

SEQ ID NO: 101342 - DNA, 781 bp, Homo sapiens
  misc_feature: GYAE6OF02HWI5Z.51.10.A10.1.454.CMB.1.raw
  modified_base (182)..(182): a, c, t, g, unknown or other
  misc_feature (182)..(182): n is a, c, g, or t
  modified_base (245)..(245): a, c, t, g, unknown or other
  misc_feature (245)..(245): n is a, c, g, or t
tcagcgatcgtatacacgaccggtgctcgatttagcgtcgatctcaggggagcttcagctgtgggtagagaagacaggactcaggacaatctccagcatggccagcttccctctcctcctcaccctcctcactcactgtgcagggtcctgggcccaatctgtgctgactcacgcccaccctnacgcgtcgtcggggacccccgggcaggacgggtccaccattcctcccttgttcgtagggaacnccaactccaacgatacggaagttactactgcagaccttacggtaccaggacaacctcccgaggtactcccggacccccaaaccttccctcgatctaactactaactaaactccgaacgggcccaacgtacggggtccctagtacccgtattccgtccgggactaccgacgtcgtacggcctaccgtacaccgtacccttcccgtacgggcccacgttccacggttccgttcccgtaccgtaagtccgttggaacggtagtcggaacggcttacgtaacttccgttacgtcggttactaccgtacttacgtaagtacggggtacttaccggtaacgttagggttttaacgtaaacgggtttcggggtttcccggggttacgggtttaccgggggaaccggggggttaaccgggaaaacccggttaaaccggtttaccgggtaacccccggttttaacggttttacccggaccggtaacccggtaacccgaaacccggggtttcccggttaacccccggtcccccggtttaacccggg

SEQ ID NO: 101343 - DNA, 678 bp, Homo sapiens
  misc_feature: GYAE6OF02IHOGJ.51.10.A10.1.454.CMB.1.raw
  modified_base (215)..(215): a, c, t, g, unknown or other
  misc_feature (215)..(215): n is a, c, g, or t
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
tcagcgatcgtatacacgaccggtgctcgatttagcgtcgatctcaggggggggggaagctcagcttcagctgtgggtagagaagacaggactcaggacaatctccagcatggccagcttccctctcctcctcaccctcctcactcactgtgcagggtcctcgggacccaatctgtgctgactcagcccaccctcagcgtcgtcgggaccccggnagacggtcaccatctctgttctggacncactaccaacatacgtaacgttatactgcagacgtcggtaccacgaccaactccgaggactcccggacccctaactcctacatctaatactaactaanccgaaccggcacgacggtccctgacctacttccnccggctacgacgtcacgcacctcaccgccctccgtcgaccgtacncgtacggtcgttccgtcctaggtccgtaggaacggtagtacggtacggtctaacctaactttacttccttcggtactaccgttatacgtaggtagggtaccttaaggtacgttaaggtttagtaacggttccggggttaccgggttacgggtttcgggaccgggggttaaccggtaacccgttaaacccggtaccggtttaacccggtttaccggtttaaccggtacggtaccccggtaaccccgtggtaccccccggg

SEQ ID NO: 101344 - DNA, 947 bp, Homo sapiens
  misc_feature: GYAE6OF02HVIDR.51.10.A10.1.454.CMB.1.raw
  modified_base (142)..(142): a, c, t, g, unknown or other
  misc_feature (142)..(142): n is a, c, g, or t
tcagcgatcgtatacacgaccggtgctcgatttagcgtcgatctcaggggagcttcagctgtgggtagagaagacaggactcaggacaatctccagcatggccagcttccctctcctcctccaccctcctcactcactgtcncgaggtccgtcgggaccctaatctgtgtcgtcgactccgacgcccaccctcgacggccgtccggtaccggggaccccccgggagaacgggacgggttcccaaccctagttccctttcccgttggttaccggtaaggggaacctaccaaaccctcccgtaaacgtacggtaacgggttaaactttaacttaaccgtcgaacgaacgtacgttccgggaaccaacggtacccaaaccttacccggaaggaacccgtaccccggtaacccccctaacgttccctactaacttaccttaacttaaccttaaccgtaaaccgtaaccggtaaacccggggacctaaccgggtaccccggggtttacccgaccggtaaccggttaccggttcccggttaccccgtccgttaaccgtaaccggtttccggtaaccggtacccttaaaccctccggtaaccccgttcccttaccccggtacgggtaaccctaccgtacggttaccgggttccgttaccccgtttacggaaccgttggttaacgggaacggtaaaccggttcgggttaaaccgtcctttaaacccgttaaacttcccggtttactacggttacgaccttagtacgtaaacggttccgggtatttaacggttaccggttttaaagtcggttaaaccgggttcgggttttaccgggtcggggttaaacggggaccgggtaaccgggtaaaccctacggtaccggtttacccgtaacgtttaccggaccgtacccggtaccggtaaccggttcccggttaccccggtacccttccgg

SEQ ID NO: 101345 - DNA, 731 bp, Homo sapiens
  misc_feature: GYAE6OF02ITC9Q.51.10.A10.1.454.CMB.1.raw
  modified_base (59)..(59): a, c, t, g, unknown or other
  misc_feature (59)..(59): n is a, c, g, or t
  modified_base (387)..(387): a, c, t, g, unknown or other
  misc_feature (387)..(387): n is a, c, g, or t
  modified_base (464)..(464): a, c, t, g, unknown or other
  misc_feature (464)..(464): n is a, c, g, or t
tcagcgatcgtatacacgaccggtgctcgatttagcgtcgatctcaggggggggggaanctcagcttcagctgtgggtagagaagacaggactcaggacaatctccagcatggccagcttccctctcctcctcaccctcctcactcactgtgcgacgggtcctcgggacccaatctgtgctgactcacgcccaccctcagccgtcgtaccggggaccccggcaggacgggtccacctatccttcctgttctaggacgacaacctaccaactagtacggtaaagtttaactacgtcgacgtagaaccgtacggtaaccacgacctaacccgtacccgaggtaccgtaccccggacccctaactcctactactactactactactaacncgacggcacggtcggtccagacgtctccgtccactaccagtctcgcctaccacgccgtccctaccggtcgaccctancgtacggtccgttctaccgagttcgacggtagtcgtaggacgtacctaacttaacgtttacccttggtacgttacgaccgttacgtacggtagggttaacggtaacgtttacggtaacggttttaacgttagggtaacgggtttccgggttaaccgggttcggggtaaccgggtaaccgggaacccggtaaacccgttacgtaaccccgggtttacccgttaccgggtttaaccgacccgttaacggtacccgggttcgtaccccgg

SEQ ID NO: 101346 - DNA, 719 bp, Homo sapiens
  misc_feature: GYAE6OF02G9NT4.51.10.A10.1.454.CMB.1.raw
tcagcgatcgtatacacgaccggtgctcgatttagcgtcgatctcagggggagcttcagctgtgggtagagaagacaggactcaggacaatctccagcatggccagcttccctctcctcctcaccctcctcactcactgtgcagggtcctgggcccaatctgtgctgactcacgccaccctcagcgtcgtcggggacccccggcaggagggtcaccatcctcctgttcgtaggaacgacaacctccaaacagtacggtaagttatacgtgacagtactacggtaccagacaacctccgaggacgtacccggacccccctaaacgtccctactaactacctaactaaccgtaactaacgtaccgaaaccggggaccaaccggtacgggggtccctaggtaaccgtactttccgtcccggtaccttaccgaacggttccgtacggacctaccgtaccgaccgtccccgtacccgtcgggaccctaagttccgaacggttaccggttcccttacccggtaagttaccgtaaggaacgggtactacgggaacggtccttaacgaaactttaccgttactggtacgactactacgtaacgtgggtaactcgtaacgttagtttaaggacgttcggggtaccgttgggttacgggacggtaacggaacctaacgtcggtaccgttacgttagacgacgtacccgaggtccctaccgtcccctagg

SEQ ID NO: 101347 - DNA, 752 bp, Homo sapiens
  misc_feature: GYAE6OF02HPFBV.51.10.A10.1.454.CMB.1.raw
  modified_base (215)..(215): a, c, t, g, unknown or other
  misc_feature (215)..(215): n is a, c, g, or t
tcagcgatcgtatacacgaccggtgctcgatttagcgtcgatctcagggggggggaagctcagcttcagctgtgggtagagaagacaggactcaggacaatctccagcatggccagcttccctctcctcctcaccctcctcactcactgtgcagggtcctgggcccaatctgtgctgactcagccaccctcacgcgtcgtcggggacccccgggnaggagggtccaccactctaccttgttcctagggaacgccaaccttaccaaactacttaccgggtaaagtttaataccgtgactacgacgttggtaacccagaccaaccgtcccgaaggaccgtacccggaccccctaaacttcccgtactatccttaactaacctaactaactaccgaaccgggacctaaacggacggggttaccctggaacccgttacgttaccgtcccgggtacctacgtaaacgtccgtcggtacctaccgtaccgaccgtcccctcccgacggtacccacgttccgagggttccggtaccttaccgtaggttcctaggacgggtattcgggaacgtctaacgtaactttaccttcgtagtacgtactacgtactaaggttcggacttccggtaagttacgggttttacgaagggttttcccggttcggggtttaacggtaccgggggtaacgggaacggtaaccgtaaccgtcggtttacccgttacgttacgaacccggtacccgcggtaaccggttccccg

SEQ ID NO: 101348 - DNA, 813 bp, Homo sapiens
  misc_feature: GYAE6OF02HYP0N.51.10.A10.1.454.CMB.1.raw
  modified_base (143)..(143): a, c, t, g, unknown or other
  misc_feature (143)..(143): n is a, c, g, or t
  modified_base (395)..(395): a, c, t, g, unknown or other
  misc_feature (395)..(395): n is a, c, g, or t
tcagcgatcgtatacacgaccggtgctcgatttagcgtcgatctcaggggtagcttcagctgtgggtagagaagacaggactcaggactaatctccagcatggccagcttccctctcctcctcaccctcctcactcactggtncaggtcctgggtccctaatctgtgtctgactcacgccacctcagccgtcgtcggggacccccgggcgaaggacggggttccaacccgaattccgtcccgttaggtttccggttaggaaacggaccaaaccttcccaaaacgtacgttaccgggaaagtttaactaaccttgaacgaagtaccgttacggttaaccgtaagccaaaccttccccaaggtaacctacccgggacccccctaaaacgtcccctanaacttccttaactaaacgtaaaccgtaaacttcggaaaaccggggtccgaacggacggggtccctaaggaccgtaactttccgaccgtacttaccaaaacgtacgtacgggactacctacgaacgtcccttaaccccggtgggaccccttaattccgtaaacggttcggtttacccctaccctaagggttcccgtacgggaacgtactagggaacgtacttaccgttaaagttaacctttccgaaaggttcacctaagtaactaggtagggtaaccttaggaaccgttgttttacgaagtttacgggtccggttaggttacgaaccggggaacgtaacccaaaccggttcgaacccgggtttacctaaggtccgaaccggtacccgaaaggtttacccttcccgaccccgtttccggg

SEQ ID NO: 101349 - DNA, 646 bp, Homo sapiens
  misc_feature: GYAE6OF02G84PY.51.10.A10.1.454.CMB.1.raw
  modified_base (141)..(141): a, c, t, g, unknown or other
  misc_feature (141)..(141): n is a, c, g, or t
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (463)..(463): a, c, t, g, unknown or other
  misc_feature (463)..(463): n is a, c, g, or t
tcagcgatcgtatacacgaccggtgctcgatttagcgtcgatctcaggggagcttcagctgtgggtagagaagacaggactcgaggacaatctccagcatggccagcttccctctcctcctcaccctcctcactcactgtncgagggtcctgggccctaatctgtgctgactcacgcccaccctnagcgtctcgggccccggnaggnggtcacatctcctgtctggaagcaactcaatgtcggaatatacgtgcganacgtggtaccagcaacnccgaggcgtaccggaccccaaactccncactacctaatacctactactacgaaccggtccagtccgggccctgaccgtacttaccggtccgtacgcctaagtccgtacggtcctaccgtcaccgtccctaccgtcggtacctagtcgtacggtcggtactccggattccgtgaacggtagtcggacggntacgtagttaccgttacgtgacctacgtatccgtagtagggtacttgggaacttgttcggtaaacgttcccgggtcgttacgggttacgggtcggtaacggttaacccgaacgttccggtaaccgtaccgtttcgaaccgtccggtaccgtaaccgggtcctacccggttaccccgtacccgg

SEQ ID NO: 101350 - DNA, 969 bp, Homo sapiens
  misc_feature: GYAE6OF02JTVTX.51.10.A10.1.454.CMB.1.raw
  modified_base (218)..(218): a, c, t, g, unknown or other
  misc_feature (218)..(218): n is a, c, g, or t
tcagcgatcgtatacacgaccggtgctcgatttagcgtcgatctcaggggagcttcagctgtgggtagagaagacaggactcaggacaatctccagcatggccagcttccctctcctcctccaccctcctcactcactgtgcgacggtccgtggacccaattcgtgtcgtctgactcacgccctacctacacggtcgtccggtccgggacccccgggngacggacgggtccaacctacttccgttccgttcgttacgtaagggtaaccaccgtaacctaacctaaacgaacgttacggtaaacgtttaactacgtcggactaacggtacttaccgggtaacctacggaacctaaccccggtaccgaacggtacccgtacccgggtaaacccccaaacgttccctaacctaacttaccttaaaccgtaacgttaacccgtaaaccggtaaccccgaaacgggggtaccctaaaccggggtaccggggtttaccccgtaaccggtaacccgttaccgtttaccccgggttacccgtacgtaaccgttaaccggttcccgttaccggacccgtttaaccgtaccgtccccgggttaccccttaccccgggacctacgttaccggtaccgggttaccggtccgttaccgtacggttacggtaacggtacggtaacggtacggtaacggtaccgttaaccgttaaacggtttccgtttacggttacgtccgtaccgtaaccggttagtaccgggttacggtaacgttaggttaacgttaagggtttaaccgtacgggtttacccggggtaccgggtttaccggggtacccgggtaccgggtaaccggttaacccggttacccggttaaccgggttaacccgtttaaacccggggtaaccgtttacccggaacccgggtttaccccgaaccgggttttacccggtccccggttacccccgggtattacccccggg

SEQ ID NO: 101351 - DNA, 725 bp, Homo sapiens
  misc_feature: GYAE6OF02JHQWR.51.10.A10.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (390)..(390): a, c, t, g, unknown or other
  misc_feature (390)..(390): n is a, c, g, or t
  modified_base (527)..(527): a, c, t, g, unknown or other
  misc_feature (527)..(527): n is a, c, g, or t
  modified_base (579)..(579): a, c, t, g, unknown or other
  misc_feature (579)..(579): n is a, c, g, or t
tcagcgatcgtatacacgaccggtgctcgatttagcgtcgatctcaggggggggaagctcagcttcagctgtgggtagagaacgacaggactcgaggactaatccgtccagcagtcggccagtccttccctacgccttcctcaccctcctacgtcctcactgtcggacagggtccgtcgggtacccaacttcgngttacgcttacggactcgacgcccaaccctgaggccgttccggaccggggacccccgngacggtacggtcactactcctcgtgttacgaggataccaccgtaccaaagcggtaacgtaagttacctacgtagaccgtacgtacggtccgtaacgaacgtacctacccgaccgacgggacctacccgaacccctacncgtactacttactactaacctaccgtagtcccggaacggccgacggcgggttacccacgtacctaggttccacggcctagacggtctaacgcccacgtactccgaccctcgacgtccacgtccgacgttcgtaaccncgtacgtacgtcggaggaacttggcccgtattcgaaacgttcctacgggttntacggttccaattagtcggtaagccttaaacgtgttaacgtgtttacggtcggtacgggttaccgacgggtaccggtaaacggaactttaacggacccgtttaccgggtacttacggaccctacccggttaccgtacggttacccc

SEQ ID NO: 101352 - DNA, 599 bp, Homo sapiens
  misc_feature: GYAE6OF02FV0UU.51.10.A10.1.454.CMB.1.raw
  modified_base (113)..(113): a, c, t, g, unknown or other
  misc_feature (113)..(113): n is a, c, g, or t
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (466)..(466): a, c, t, g, unknown or other
  misc_feature (466)..(466): n is a, c, g, or t
tcagcgatcgtatacacgaccggtgctcgatttagcgtcgatctcaggggagcttcagctgtgggtagagaagacaggactcaggacaatctccagcatggccagcttccctntccctcctcaccctcctcactcactgtgcagggtcctggggcccaagtctgtgctgactcagccaccctnagcgtctgggacccccgggnagagggtcaccatctcctgttcgtggacgtcaactccaacatacggaagttatactggcagtactcggtaccgagacgtaacctccgtaaggactcccggacccccaaactcctacactcctatacttactaatcgaacggccacgacgggtcctagaccgattctaccggctaccagtcgtagctacctcgactcccgttcccggacctatcgtaaggtcggtcctcgaagttctacgtagtacgtgacgtacttcaacttnttcgtgtcgcactacgtactgggtactgtaagtaccgttaggtacgttggtaccggttcggttacgggacggtaacggtaccgtaaagtccggtaccgtacgttactcgacgtaccgagccgtcgacccgtcg

SEQ ID NO: 101353 - DNA, 598 bp, Homo sapiens
  misc_feature: GYAE6OF01EC76Y.53.16.B05.1.454.CMB.1.raw
tcagcgcgtatacacacgaccggtgctcgatttagagctcacgtaagttggggtttggggagtcccaggtcaggacacagcatggaacatgaagggtccccgctcagctcctggggctcctgcgtgctctggctcccaggtgccagactgtgaacatcccagttgacccagtctccatccttcctgtctgcgtctgtgggagactagagtctaccttcacttagccgggccagtcagggctattagcgtacttcttagcctggtatcgacgacgaaaacgccgagggactcggcccctaagcctcctcactactaacgtcgactcggtcctttcccgactttcgcctagtaacgtcggggtctcactcgaaggttcggcggcgacgcggatcgtggacagtactcactctacactaacttaccaacctgacgagcctgactgtactttcgactaacttattactgtacaagtagttgaacttacttaccgtcggttacgttttcggaccgtacggggtaccaaggtcctagggtaccgttacgaaacgtcgtaaacgttggtacggtctacgtcctaaccattccttgttcctttacc

SEQ ID NO: 101354 - DNA, 854 bp, Homo sapiens
  misc_feature: GYAE6OF01CQK9M.53.16.B05.1.454.CMB.1.raw
  modified_base (201)..(201): a, c, t, g, unknown or other
  misc_feature (201)..(201): n is a, c, g, or t
tcagcgcgtatacacacgaccggtgctcgatttagagctcacgtatttggggtttggggagtcccagtcaggacacagcatggacatggacgggtccccgctcagctcctggggctcctgctgctctggctcccaggtgccagatgtgacatccagttcgacccagtctccatccttcctgtctcgtcgtcgtggtggganacgagtacgtcctaccttctacgttcggcccgggccagtcgagggtactagttacgaccgtacttcgttagccgttaggtactaccgaacgaaccgtaaaacgggcccggtaaaggggtacgtaccccgggtacccccttaaaggtccccttaccctaccgtaacctttaccgttacgtcggttacccttacgttccccttttaccgttacgttttaccggccgtaaagggtttcggggttccggggtttacctaccgttaaggttacccgggtaacgggggttacccggggtccggtaacggtccggggtaccggtacggttacccggggttaagggaaccgttaagtaaccctttcctaaccgttaccctaacgtaaccgtaaacccttaacccgaccgttacgacgtacccgtacgttacgtaacgtttagtttacgttaacgtacctttaactttacgttaccgttagttaaccgtaacgttaaggtttaccgttaaccgttttaacccgttacccgggtttacggtttaccggtttaccgggaaccggtaaccgggtacggtaccgtaccggtaccggtacgtacggaacggtagtaacggtcgggtagtccctagtacccgtacttaggcctttggtcctttccccg

SEQ ID NO: 101355 - DNA, 786 bp, Homo sapiens
  misc_feature: GYAE6OF01C2C9X.53.16.B05.1.454.CMB.1.raw
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagcgcgtatacacacgaccggtgctcgatttagagctcacgtagttggggtttggggagtcccagtcaggacacagcatggacatggagggtccccgctcagctccgtggggctccgtgctgctctggctccaggtgccagtatgtcgacactaccgtagttcgaaccctagtcctcctacttccttccgtcgtctcgtcgtcgtgggacgggactacgaagtacgtctaccttccgacgttcgggaccggccaggtcgaggtctagttacgcgtacttcgttagcctaggtacacgaagaacaaaggccgagggtactaccggacctanccttactactaatcttancgtctctactcctattgacgttagtcgggttcgtactacgtaacgtacggtaaacggggtccgacgggaacgtacgggtaccggtagtaacggtaacgggaaacgtaacggtaacttaccgactacgtaacctaaacgtaacccttaaaccgacccgtaaggtacctaaccgttcgtaagtaggtttactaaaccgggttttaactaaacccttttaaacgtttaccgttaaacccgttggttaaaaccgttaaagggtttaaccgtttaacgggttaacccctttaaaccccggttaccggggttttaccggttaacccggggtttaccgggaaacggtaacgggtaaccctaaagggtccgttaaacgggttaccaaacggacgtaaaccgtgtggtcccggataccgaacctcgttagtcttcgtacttaccg

SEQ ID NO: 101356 - DNA, 792 bp, Homo sapiens
  misc_feature: GYAE6OF02JOA0Z.53.16.B05.1.454.CMB.1.raw
  modified_base (384)..(384): a, c, t, g, unknown or other
  misc_feature (384)..(384): n is a, c, g, or t
tcagcgcgtatacacacgaccggtgctcgatttagagctcacgtagttgggtttgggggacgtcccagtcaggacacagcatggacatgaggtccccgctcagctcctgggctcctgctgctctggctccaggtgccagatgtgaccatccagttcgacccagtcctccacttcccttcctggttctcggtccgttcctggtacgggacgaccaggtacgtccaccgttcgacgttcggccgggacctaggtccgagggctagtagccgtacttacgttacgccgttaggtataccgagaactaaacggccgtacggtactccggtacccctaaggcccttaccgtcgactacgttacgtcgtacgtcgtacctcctgttacgntacgtggtacggtctcgtacgtacggtacgggtccgtcgggtactacgggtacgtcgttcggtacggtacgtaacgtacggttccctacgtaccgttaacgtaaacccgtttaaccgttaccctaaaccggttccgtaaccgtaaccgtccgtaacgttacggtaacgtttacgtttaccgtaccttttaaacgttaacccgtttacggtaacttaccgtaacgtttaacggttacctaaaccgttttacccgttacccggtttacgttacggtttaccggaaccgggttaaccggtaccgtacgttcccgggtagtaaccgtaccgtaaaccgggtcttaacggtcggttaaaccgtccgttaaccgtaccggttacctagttacccggttcgttacccgttaccgg

SEQ ID NO: 101357 - DNA, 659 bp, Homo sapiens
  misc_feature: GYAE6OF02GV9UP.53.16.B05.1.454.CMB.1.raw
  modified_base (196)..(196): a, c, t, g, unknown or other
  misc_feature (196)..(196): n is a, c, g, or t
tcagcgcgtatacacacgaccggtgctcgatttagagctcacgtagttgggtttggggagtcccagtcaggacacagcatggacatgagggtccccgctcagctcctggggctcctgctgctctggctcccaggtgccagatgtgacatccagttcgacccagtcctccatccttcctgtctgcgtctggtggganacagagtcctaccttcacttcggcccggccagtcgagggcctagttaggccgtacttcgtttacgccgtggtactcgacgacaaaacgccgaggactcggaccctaagccctcctcatctatcgctcgtcttacctcttcgctaagttggtcggtctacgtatacgacgggttcggcggcaggtcggtagtcggtaggaactaggtacttacgtaccgtcctaaccgtaactaaaccttacccgaaccgttaggccaacggtcctagtacgttaattagtttccgaactttaactttgttacctaagttaccgtaaagttgggttaacttacgtttaacccgtttaccgttaccgttttacgttaccgggaaccggtacccgggtagaaccgttgtacgggtaactacgtaacggacggttacgtggagtcctacgacctacgtacgtcgttacgtcttaccg

SEQ ID NO: 101358 - DNA, 510 bp, Homo sapiens
  misc_feature: GYAE6OF01CW1OJ.8.67.G01.1.454.CMB.1.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
tcagctcgcgtgtccacgaccggtgctcgatttagagtatacatattgggtttgggggcttttcctgggctcctgctacctctgggctccgaggtgcccagatgtgacatccagatgacccagtctccatcctccctgtcctgcttctataggagacagagtcaccatcacttgccgggcaagtcagaccattaggacacctttttaatcggtatcaacagagcccaggaaaagccccaaaatcctgatttanggtncatccatttcgcaaaagtcgggtcccatcaaggttcagtggcagtggatctggggcagactttccaccctcaccatccagcagtctgcaacctgaagactttgactaacttactactgtcagcagtcttacagtagccgggnacctttggccagggactaagtctaggganatcgaagtactgtggctgcaccattcgtgtcttcatctcccgcatctgagacacgcgagctgacgccgggctggcaaggcac

SEQ ID NO: 101359 - DNA, 515 bp, Homo sapiens
  misc_feature: GYAE6OF01B4X06.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaaggaaaacgcccccaaaactcctgattttatggtgcatccatttcgcaaagtgggtcccatcaaggttcagtggcagtggatcgtggggcagatttcaccctcaccatcagcagtctgcaacctgaagactttgctaacttactactgtcagcagttcttacagtacggccggctaccgtttggccgaggggacgaagcgtgggagatcgaacgactgtgctgcaccatctgtcttcactccttcccgcctatctgacgacacgcacgctggagcgggctgggcaaggcgacg

SEQ ID NO: 101360 - DNA, 518 bp, Homo sapiens
  misc_feature: GYAE6OF01C0XP6.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaactcctgatttatggtgcatccatttcgcaaagtggggtcccatcaaggttcagtggcagtggatcgtggggcagatttcaccctcaccatcagcagtctgcaacctgaagactttgactaacttactactgtcagcagtcttacagtaggccggctaccgtttggcccgaggggacgaaggcgtggagagtcgaacgaactgtggctgcaccatctgtcttcactccttcccgcctactctagaccacgcgagctggacggcgggctagggcaaggcgcag

SEQ ID NO: 101361 - DNA, 528 bp, Homo sapiens
  misc_feature: GYAE6OF01C5AL9.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgcccccaaaactcctgatttatggtgcatccatttcgcaaagtgggtcccatcaaggttcagtggcagtggatcgtggggcagatttcaccctcaccatcagcagtctgcaacctgaagtactttgactaacttactactgtacagctagtcttacagtacggccggctaccgtttggccgtaggggacgaagcgtggagagtacgaacgacgtgtggctcgcacctatctgtcttcactccttcccgctactctagacgaccgacgcgagctggacggtcgggctggcgaggcgacg

SEQ ID NO: 101362 - DNA, 494 bp, Homo sapiens
  misc_feature: GYAE6OF01EUVQN.8.67.G01.1.454.CMB.1.raw
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaactcctgatttatggtgcatccatttcgcaaagtgggtcccatcaaggttcagtggcagtggatctggggcagatttcaccctnaccatcagcagtctgcaacctgaagctttgcaacttacactgtcagcagtcttacngtaggccggcacctttgggccaggggacgaagctggagatcgaacgaactgtggctgcaccatctgtcttcatcttcccgcatctgagacacgcgagctgacgcgggctggcaaggcgc

SEQ ID NO: 101363 - DNA, 531 bp, Homo sapiens
  misc_feature: GYAE6OF01CBU88.8.67.G01.1.454.CMB.1.raw
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaagcccccaaaactcctgatttanggtgcatccatttcgcaaagtgggtccatcaaggttcagtggcagtggatcgtggggtanatttcaccctcaccatcaacagtctgcagattgaggattatgacaacttattactntcagcagacgttccacggacccgctcgtacgtttcgggcgggggaaccaaggtcggacgtacaaacggaactgtaggctcgcaccatctgtcttcattccttcccgactactctagacgacgtacgcgacgctaggacggcgggctggacgaacggcgcagtgcg

SEQ ID NO: 101364 - DNA, 504 bp, Homo sapiens
  misc_feature: GYAE6OF01A483V.8.67.G01.1.454.CMB.1.raw
  modified_base (478)..(478): a, c, t, g, unknown or other
  misc_feature (478)..(478): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtggggtcccatcaaggttcagtggcagtggatctggggcagatttcaccctcaccatcagcagtctgcaacctgaagactttgcaactttactactgtcagcagtcttacagtaggccgggcacctttggccaggggacgaagctgggagatcgaacgactgtggctgcaccatctgtcttcatccttcccgcatctgacgtcacgcgngctggagcgggctgggcaaggcgacg

SEQ ID NO: 101365 - DNA, 503 bp, Homo sapiens
  misc_feature: GYAE6OF01B2TZ3.8.67.G01.1.454.CMB.1.raw
  modified_base (249)..(249): a, c, t, g, unknown or other
  misc_feature (249)..(249): n is a, c, g, or t
  modified_base (376)..(376): a, c, t, g, unknown or other
  misc_feature (376)..(376): n is a, c, g, or t
  modified_base (499)..(499): a, c, t, g, unknown or other
  misc_feature (499)..(499): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttanggtgcatccatttcgcaaagtgggtccatcaagttcagtggcagtggatcgtggggcagtatttcacctcaccatcagcagtctgcaactgaagtctttgactaacttactactgtcagcagtctanagtacggccggcacgtttggccgagggacgaagcgtggagatcgaacgactgtgctgcaccatctgtcttcatccttccgcactctgacgaccacgcgagctggacgcgggctagggcaaggngacg

SEQ ID NO: 101366 - DNA, 497 bp, Homo sapiens
  misc_feature: GYAE6OF01CZZOD.8.67.G01.1.454.CMB.1.raw
  modified_base (248)..(248): a, c, t, g, unknown or other
  misc_feature (248)..(248): n is a, c, g, or t
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaatcctgatttanggtgcatccatttcgcaaagtgggtcccatcaaggttcagtggcagtggatctggggcagatttcaccctcaccatcagcagtctgcaacctgaagactttgctaacttactactgtcagcagtcttacagtacggccgggctaccgtttggccaggggacaagctggagatcgacgaactgnggctgcacatctgtcttcatctcccgcatctgagacacgcgngctgacgcgggctggcaggcgacg

SEQ ID NO: 101367 - DNA, 511 bp, Homo sapiens
  misc_feature: GYAE6OF01BSSRC.8.67.G01.1.454.CMB.1.raw
  modified_base (479)..(479): a, c, t, g, unknown or other
  misc_feature (479)..(479): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacaagctggagatcgaacgactgtggctgcaccatctgtcttcactccttcccgccatcctgacgaccacgcgngcgtggacggtccgggctgggcaagggcgacg

SEQ ID NO: 101368 - DNA, 520 bp, Homo sapiens
  misc_feature: GYAE6OF01BMNSJ.8.67.G01.1.454.CMB.1.raw
  modified_base (385)..(385): a, c, t, g, unknown or other
  misc_feature (385)..(385): n is a, c, g, or t
  modified_base (492)..(492): a, c, t, g, unknown or other
  misc_feature (492)..(492): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaaactcctgatttatggtgcatccatttcgcaaagtgggtcccatcaaggttcagtggcagtggatcgtgggcagatttcaccctcaccatcagcagtctgacaacctgaacgtactttgactaacttactactgtcagcagtctanagtacggcggctacgtttggccgagggacgagcgtaggagagtacgaacgaacgtggtggctgcaccatctgtcttcactccttcccgctatctagacgacacgcgngcgtggacgtcgggctaggcaggcgacg

SEQ ID NO: 101369 - DNA, 505 bp, Homo sapiens
  misc_feature: GYAE6OF01AF473.8.67.G01.1.454.CMB.1.raw
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (432)..(432): a, c, t, g, unknown or other
  misc_feature (432)..(432): n is a, c, g, or t
  modified_base (481)..(481): a, c, t, g, unknown or other
  misc_feature (481)..(481): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaactcctgatttanggtncatccatttcgcaaagtgggtcccatcaaggttcagtggcagtggatcgtggggcaggatttcaccctnaccatcagcagtctgcaactgaagctttgcaacttnactgtcagcagtcttacagtaggccggctaccgttggcccgaggggacgaagctagggaagatacgaagactggngctgcaccagtctgtcttcatcttcccgctatccgtgacgaccgcgcgngctggacgcgggctggcaggcacg

SEQ ID NO: 101370 - DNA, 499 bp, Homo sapiens
  misc_feature: GYAE6OF01DTWL7.8.67.G01.1.454.CMB.1.raw
  modified_base (249)..(249): a, c, t, g, unknown or other
  misc_feature (249)..(249): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttanggtgcatccatttcgcaaagtgggtcccatcaaggttcagtggcagtggatctggggcagatttcacctcaccatcagcagtctgcaacctgaaagctttgcaacttactactgtcagcagtcttacagtaggccgggcaccgtttggccaggggacgaagcgtggagatcgaacgaactgtggctgcaccatctgtcttcatcttccgcatctgagacagcgagctgacgcgggactggcaaggcgacg

SEQ ID NO: 101371 - DNA, 521 bp, Homo sapiens
  misc_feature: GYAE6OF01EQ0BJ.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgccccccaaaactcctgattttatggtgcatccatttcgcaaagtggggtcccatcaaggttcagtggcagtggatctggggcagatttcaccctcaccatcagcagtctgcaacctgaagactttgactaacttactactgtcagcagtcttacagtaggccgggctaccgtttggccgaggggacgaagcgtgggagatcgaacgaactggtggctgcaccatctgtcttcactccttcccgctactctgacgacacgcgcgcgtggacggcgggctgggcgaaggcgacg

SEQ ID NO: 101372 - DNA, 512 bp, Homo sapiens
  misc_feature: GYAE6OF01ATI8B.8.67.G01.1.454.CMB.1.raw
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaacgcccccaaaactcctgatttatggtgcatccatttcgcaaagtgggtcccatcaaggttcagtggcagtggatcgtggggcagatttcaccctcaccatcagcagtctgcaacctgaagtactttgactaacttactactgtcagcagtcttanagtaggccggctaccgtttggccgaggggacgaagcgtggagatcgaacgactgtggctgcaccntctgtcttcactctcccgctatctgacgacacgcgagctgacggcgggctgggcaagggcgacg

SEQ ID NO: 101373 - DNA, 545 bp, Homo sapiens
  misc_feature: GYAE6OF01C3VIF.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaaactcctgattttatggtgcatccatttcgcaaagtgggtcccatcaaggttcagtggcagtggatcgtggggcagatttcaccctcaccatcagcagtctgacaaccgttgaaacgtactttgactaaacttactactgtcagcagtcttacagtacggccggactaccgtttggacccgaggggacgaagcgtagggagtagtacggaacgacgtggtcggcgtgccaccattccgtgttcttctacttccttcccgctatcctagacgacacggcgacgctggacgcgggactggcaggcacg

SEQ ID NO: 101374 - DNA, 509 bp, Homo sapiens
  misc_feature: GYAE6OF01D9P2Q.8.67.G01.1.454.CMB.1.raw
  modified_base (497)..(498): a, c, t, g, unknown or other
  misc_feature (497)..(498): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaaccttttttaaattggtatcaaacagagccccaaggaaaacgcccccaaaactcctgattttatggtgcatccatttcgcaaagtgggtcccatcaaggttcagtggcagtggatcgtggggcagatttcaccctcaccatcagcagtctgcaactgaaagctttgctaacttactactgtcagcagtcttacagtaggccgggctacctttggcccgaggggacaaggctggagatcgaacgaacgtgtggctgcacatctgtcttcatctcccgcatctgagacacgcgagctgagcgggnngggcaggcgac

SEQ ID NO: 101375 - DNA, 521 bp, Homo sapiens
  misc_feature: GYAE6OF01E2C7S.8.67.G01.1.454.CMB.1.raw
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaagcccccaaaatcctgatttanggtgcatccatttcgcaaagtgggtccatcaaggttcagtggcagtggatcgtggggcagatttcaccctnaccatcagcagtctgacaacctgaagactttgactaaacttactactgtcagcagttctacgagtaggccggctaccgttggccgaggggacgaagcgtggagatacgaacgtaacgtgtggctgcacctatctgtcttcatcctcccgcatctagacgaccaggcgagcgtaggacggccgggactaggcgaaggcgacg

SEQ ID NO: 101376 - DNA, 510 bp, Homo sapiens
  misc_feature: GYAE6OF01CMM4Q.8.67.G01.1.454.CMB.1.raw
  modified_base (248)..(248): a, c, t, g, unknown or other
  misc_feature (248)..(248): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaactcctgatttanggtgcatccatttcgcaaagtgggtcccatcaaggttcagtggcagtggatcgtggggcagatttcaccctcaccatcagcagtctgcaacctgaagactttgctaacttactactgtcagcagtcttacagtacggccggctaccgtttggccgagggacgaagcgtggagatacgaacgaactgtggctgcaccatctgtcttcatccttccgcctatcgtgacgacacgcgagcgtggacgcgggctgggcaggcgacg

SEQ ID NO: 101377 - DNA, 529 bp, Homo sapiens
  misc_feature: GYAE6OF01DOP2V.8.67.G01.1.454.CMB.1.raw
  modified_base (260)..(260): a, c, t, g, unknown or other
  misc_feature (260)..(260): n is a, c, g, or t
  modified_base (451)..(451): a, c, t, g, unknown or other
  misc_feature (451)..(451): n is a, c, g, or t
  modified_base (517)..(517): a, c, t, g, unknown or other
  misc_feature (517)..(517): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaaacagagccccaaggaaaacgccccccaaaactcctgatttatggtncatccatttcgcaaagtgggtcccatcaaggttcagtggcagtggatcgtggggcagatttcaccctcaccatcagcagtctgcaacctgaagtactttgactaacttactactgtcagtcagttcttacaggtacggccgggctaccgtttggccgaggggacgaagcgtaggagatacgaacgaactgnggctgcaccatctgtcttcattccttcccgcctatctgacgacgacgcgagcgtggacggcgggcnggacaggcgacg

SEQ ID NO: 101378 - DNA, 526 bp, Homo sapiens
  misc_feature: GYAE6OF01BG465.8.67.G01.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaaatcctgatttanggtncatccatttcgcaaagtgggtccatcaaggttcagtggcagtggatcgtgggcagatttcacctcaccatcagcagtctgcaacctgaatactttgactaacttctactgtcagactagttcttaacgagtacggcccgggactaccgtttggaccgaggggacgaagcgtaggagatcgaacgactggtgctgcacagtctgtcttcactctcccgctactctgacgaccgacgcgacgcgtaggacggcgggtactaggcacgggcgacg

SEQ ID NO: 101379 - DNA, 504 bp, Homo sapiens
  misc_feature: GYAE6OF01B98KT.8.67.G01.1.454.CMB.1.raw
  modified_base (254)..(254): a, c, t, g, unknown or other
  misc_feature (254)..(254): n is a, c, g, or t
  modified_base (436)..(436): a, c, t, g, unknown or other
  misc_feature (436)..(436): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaaactcctgatttatggtncatccatttcgcaaagtgggtccatcaagttcagtgcagtggatcgtgggcagtatttcaccctcaccatcagcagtctgcaacctgaagtactttgactaacttactactgtcagcagttcttacagtacggccggcaccgtttggccgaggggacgaagcgtggagatacgaacgactgngctgacacatctgtcttcactctcccgcatcctgacgcgacgcgagctgacgcggctaggcaggcgag

SEQ ID NO: 101380 - DNA, 605 bp, Homo sapiens
  misc_feature: GYAE6OF01EOYLV.8.67.G01.1.454.CMB.1.raw
  modified_base (258)..(258): a, c, t, g, unknown or other
  misc_feature (258)..(258): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagagcccaaggaaaacgcccccaaactcctgtatttagtggtnctatccatttcgacaaagtcggggtcccatcaaggttcagtggcagtggatcgtggggcagtatttccaccctcaccatcagcagtctgaccaactgaagtactttgactaacttactactcgtcagctagttcttacgaggtacggccggctaccgtttcgggaccgaaggggacgaaggtcgtagggaacgacgtacggtaacgtacgtggtcggtctcggacctaaccgtacgttcgttcgttacctttcctaccgtttcccgttccccgccttacgtccgtacggacgaacccgtacggacgtccgtggacggccgggtcgtacggacgacgggcgacgtacg

SEQ ID NO: 101381 - DNA, 753 bp, Homo sapiens
  misc_feature: GYAE6OF01C6BNF.8.67.G01.1.454.CMB.1.raw
  modified_base (152)..(152): a, c, t, g, unknown or other
  misc_feature (152)..(152): n is a, c, g, or t
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctagtcttatagaganacagtctacactntctagtcggcgatacncgacactagtcacctttaactttagtgtacacanagccacgaaagacccaccactnatatgngcntctctntcaagtaggtcgacntacgtagtnggcgatggagtactggggcgatagttcctacccacctacactcacgacgcgtacgtcgacaaaccctagtaaggtaacttacgttacaaaccttaaccttagtacgttcgacgtacggtacttaacgtttacccgtaaggtacggggtacccggggtaccggtaccccgtttacggggtttacccgggaaaccgggggaacgggggtaaacgaacggttacggggtaacgggtaacgtaaccggtaaacccgggtaaaacggtaccgggttaggggtcggttacccgtaaccggtaacccctaacccggttacttttaccggttcccgtttttaaccgtacccttaacccggtttccccccgtttaccccggatttacccgttaccggaaggtaacccccgtaacgggtaccgggacggtacggttcggaacgggtaccggggcggttacggacgggtaacggaacgggtcctaaag

SEQ ID NO: 101382 - DNA, 505 bp, Homo sapiens
  misc_feature: GYAE6OF01BSRG6.8.67.G01.1.454.CMB.1.raw
  modified_base (481)..(481): a, c, t, g, unknown or other
  misc_feature (481)..(481): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgccccccaaactcctgatttatggtgcatccatttcgcaaagtgggtcccatcaaggttcagtggcagtggatcgtggggcagatttcaccctcaccatcagcagtctgcaacctgaagactttgactaacttactactgtcagcagtcttacagtaggccggctaccgtttggccgaggggacgaagcgtggagatcgaacgactgtggctgcaccatctgtcttcatcctcccgctatctgacgcagcgngctggagcgggctggcaggcgacg

SEQ ID NO: 101383 - DNA, 661 bp, Homo sapiens
  misc_feature: GYAE6OF01C5536.8.67.G01.1.454.CMB.1.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatacaacagacgacccaaggaaaaccgccccccaaaactcctagtaacttttagngggtnacattccctatttaccgacgaaaggttcggggtaccctatacgtaaggttcaggtggcaggtggatcgtggggacagtactttccacctcacctatcagctacgtctacgacctaaccgtagaacgtacgtttacgaccttaaacttacgtacgttacgtacgaacgtacgtaacgttaccgttaacgacgggttaccgggcccgggtaccttaccggtttacgggaccgtaaggggaacgtaacggtacgtagggaacgtacgtaccggaacgtacgttggacggtctcgaccacgtacttcgtcgttacctctacgtccctacccgctactcgtagacgtacgacgacggcgtacgtaggacggtcgggtacgtaggacgaggcgtaacg

SEQ ID NO: 101384 - DNA, 522 bp, Homo sapiens
  misc_feature: GYAE6OF01EJMMI.8.67.G01.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (323)..(323): a, c, t, g, unknown or other
  misc_feature (323)..(323): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaaatcctgatttatggtncatccatttcgcaaagtgggtcccatcaaggttcagtggcagtggatcgtggggcagatttcaccctnaccatcagcagtctgcaacctgaacgactttgactaactttactactgtcagcagtcttacagtacggccggctaccgtttggccgaggggacgaagcgtggagatacgaacgactgtggctgcaccatctgtcttcacttccttcccgcctactctagacgacacgcggagcgtgacggcgggcgtggcgaggcgacg

SEQ ID NO: 101385 - DNA, 636 bp, Homo sapiens
  misc_feature: GYAE6OF01ED1TV.8.67.G01.1.454.CMB.1.raw
  modified_base (176)..(176): a, c, t, g, unknown or other
  misc_feature (176)..(176): n is a, c, g, or t
  modified_base (234)..(234): a, c, t, g, unknown or other
  misc_feature (234)..(234): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctacctttttaaatggtatcaacagacgacccaaggaaaaccncccccaaactcctgtatttagtggtgactatcctatttcgacgtaaaggtcggggtacccagtacgtaaggttcaggtggactaggtggatcggtggggctagtactttccaccctcaccatcagcagtctgacaacgtagaacgtactttgactaacttactactgtacagtctagttacttacgacggtacgggccggtactaccggtttcgggaccggtaggggaacgtaaggcgtagggagtacgtacggaaacgtacgtggtacggctcggacctacctagttccgttcgttaccttctaccgttcccgttaccccgactacgttcgtacggaacgtacccgacggtacggtacggtacggacgggccgggtacgtacgggacgacggtcgacgtag

SEQ ID NO: 101386 - DNA, 541 bp, Homo sapiens
  misc_feature: GYAE6OF01CCU6Q.8.67.G01.1.454.CMB.1.raw
  modified_base (467)..(467): a, c, t, g, unknown or other
  misc_feature (467)..(467): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaactcctagtatttatggtgcatccatttcgacaaagtgggtcccatcaaggttcagtggcagtggatcgtggggcagtactttcaccctcaccatcagcagtctgcaactgaagtctttgactaacttactactgtacagcagttacttacgagtacggccggtctacgtttggaccgaggggacgaagcgtggagagtacgaacgaacgtggtgctgacacatcgtntcttcacttccgttcccgctactcgtgaacgccacggcgacgcgtggacggtccgggctagggacagggcgacg

SEQ ID NO: 101387 - DNA, 545 bp, Homo sapiens
  misc_feature: GYAE6OF01BI345.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgcccccaaactcctgatttatggtgcatccatttcgacaaaggtggggtcccatcgaaggttcagtggcagtggatcgtggggcagatttccaccctcaccatcagcagtctgacaacctgaacgtactttgacctaaacttactactgtcagctagtacttacgagtacggccgggctaccgtttgggaccgaggggacgaagcgtggagatacgaacgaactggtcggctgcacatctgtcttctactcttcccgctagtcagacgaccacggacgcgccgtggacggcgggactgggaccgaaggccggacg

SEQ ID NO: 101388 - DNA, 518 bp, Homo sapiens
  misc_feature: GYAE6OF01BNHR2.8.67.G01.1.454.CMB.1.raw
  modified_base (475)..(475): a, c, t, g, unknown or other
  misc_feature (475)..(475): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagccccaaggaaaaacgccccccaaaatccctgattttatggtgcatccatttcgcaaagtgggtcccatcaaggttcagtggcagtggatcgtggggcaggtatttccaccctcaccatcagcagtctgcaacctgaatctttgactaacttacactgtcagcagtcttacgagtaggccggcaccgtttggccgaggggacgaagctgggagagtacgaacgactgtgctgcaccatctgtcttcatcctcccgctntctgacgacacgcgacgctgacggtcggactggacaggcgacg

SEQ ID NO: 101389 - DNA, 518 bp, Homo sapiens
  misc_feature: GYAE6OF01A45LI.8.67.G01.1.454.CMB.1.raw
  modified_base (454)..(454): a, c, t, g, unknown or other
  misc_feature (454)..(454): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaagcccccaaactcctgatttatggtgcatccatttcgcaaagtgggtcccatcaaggttcagtggcagtggatcgtggggcagatttcaccctcaccatcagcagtctgacaacctgaacgtactttgactaacttactactgtcagcagtcttacagtacggccggctaccgtttggccgaggggacgaagctagggagatcgaacgaactggtggctgacaccntctgtcttcatccttcccgctatcgtgacgacacgcgagcgtgacggcgggctggcaggcgacg

SEQ ID NO: 101390 - DNA, 616 bp, Homo sapiens
  misc_feature: GYAE6OF01CLR2V.8.67.G01.1.454.CMB.1.raw
  modified_base (146)..(146): a, c, t, g, unknown or other
  misc_feature (146)..(146): n is a, c, g, or t
  modified_base (235)..(235): a, c, t, g, unknown or other
  misc_feature (235)..(235): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctanaggagacagagtcaccatcacttggccgggcaagtcagaccattagcttaacctttttaaatggtatcaacagacgcccaaggaaaacncccccaaaatcctagtaatttagtgggtcactatcctatttcgacgtaaaggtcggggtacccatacgtaaaggttcaggtggctaggtggatcgtgggcagtattccacctacaccatcagcagtctgactaacgtagaagtactttgactaacttactactgtcagcagtctacgaggtacggcgggctacggttggacccgaggggaacgaagtcgtagggaagtaactaccgggaaacgtacgtggttaggacctggacctaaccgtattccgttacgttaccttacgtacttcccgttacccggcctattccgagaaccgtaccgaccggtcggagccgtaggaccgggccgggtatacgggagaacggccgtaag

SEQ ID NO: 101391 - DNA, 174 bp, Homo sapiens
  misc_feature: GYAE6OF01EW2SL.8.67.G01.1.454.CMB.1.raw
  modified_base (173)..(174): a, c, t, g, unknown or other
  misc_feature (173)..(174): n is a, c, g, or t
tcagctcgcgtgtccacgaccggtgctcgatttagagtatacatattgggtttgggggaagaggaagactgacggtcccccaggagttcaggtgctgggcacagcggccctgggctgcctggtcaaggactacttccgacacgcgagctgagcgggctggcaaggcgcatagnn

SEQ ID NO: 101392 - DNA, 514 bp, Homo sapiens
  misc_feature: GYAE6OF01E3WDU.8.67.G01.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (468)..(468): a, c, t, g, unknown or other
  misc_feature (468)..(468): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatccacttgccgggnaagtcagaccattagctacctttttaaatggtatcaacagagcccaaggaaaacgcccccaaaatcctgatttanggtgcatccatttcgcaaagtgggtcccatcaaggttcagtggcagtggatctggggcagatttcaccctcaccatcagcagtctgcaacctgaagtctttgctaacttactactgtcagcagtcttacagtacggccgggctacgtttggccaggggacgaagctagggagatcgaacgaactgtaggctgcacatcgtgtcttcatccttcccncactctgacgacacgcgagctggacggcggactggcagggtcgacg

SEQ ID NO: 101393 - DNA, 543 bp, Homo sapiens
  misc_feature: GYAE6OF01EDUMA.8.67.G01.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccatttcgcaaagtgggtcccatcaaggttcagtggcagtggatcgtggggcagatttcaccctcaccatcagcagtctgcaacctgaacgtactttgactaacttactactgtcagctagtcttacgagtacggccggctaccgttggaccgaggggacgaagcgtggagagtacgaacgacgtgtcggctgcacatcgtgtcttcactccgttcccgctactccgtaggacgtaccgacggacgtacgcgtggacgggtccgggacgtgggaccgagggcgacg

SEQ ID NO: 101394 - DNA, 540 bp, Homo sapiens
  misc_feature: GYAE6OF01A8HSW.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgccccccaaaactcctagattttatggtgcatccatttcgcaaagtgggtcccatcaaggttcagtggcagtggatctggggcagatttcaccctcaccatcagcagtctgacaacctgaacgtactttgctaacttactactgtcagcagttcttacgaggtacggcccgggtactaccgtttgggacccgtaggggaacgaagcgtgggagtagtacggaacgactggtggctgcactatctgtcttcactcctccgctatctagacgacacgcgacgcgtgacggtcgggctacgggacgaggcgacg

SEQ ID NO: 101395 - DNA, 522 bp, Homo sapiens
  misc_feature: GYAE6OF01B4193.8.67.G01.1.454.CMB.1.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaagcccccaaactcctgatttatggtncatccatttcgacaaagtgggtcccatcaaggttcagtggcagtgatcgtgggcagntttcaccctnaccatcagcagtctgcaactgaanctttgacaacttacactgcagcagttctacagtacggccggctaccgtttggccgaggggacaagctggagatcgaacgactgtcggctcgcacctatcgtgttcttacacttcccttacccgcctatccgtagacgaccacgcgcgcgtggacggtcgggctaggccaggcgtacg

SEQ ID NO: 101396 - DNA, 558 bp, Homo sapiens
  misc_feature: GYAE6OF01A1IWN.8.67.G01.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (507)..(507): a, c, t, g, unknown or other
  misc_feature (507)..(507): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatcctatttcgactaaaggtggggtcccatcaaggttcagtggcagtggatcgtggggcagtactttccaccctcaccatcagcagtctgacctaacctgaacgtcttttgactaaactttactacttgtacaagtctagttcttaacgaggttacgggccggtctaccgtttcggaccgaggggacgaagcgtaggacgtagtacgaacgactggtcggctgccactctcgttgtcttcacttccgtcccnctatcgtagacgtacacgcgcgtcgtggacggtcggcgcggacaggcgacg

SEQ ID NO: 101397 - DNA, 604 bp, Homo sapiens
  misc_feature: GYAE6OF01DLNMZ.8.67.G01.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagacccaaggaaaacgcccccaaaactcctgtatttanggtncatccatttcgcaaagtgggtcccatcaaggttcagtggcagtggatcgtggggcagtatttccacctcaccatcagcagtctgcaacctgaagtactttgactaacttactactgtcagctatctacagtacggccggactacgttggcgaggggacgaagcgtaggagtactacggaacgtacgtggtcggcgtcgaccacctacgttccgttcgttcctttacctaaccgtttcccttcccccgggtaccctaacgttacccgttacggaacggtaaccccacggtcccggaacggcccgttagggacgggtcccggggcgtacgggaccaacgggtcgaacg

SEQ ID NO: 101398 - DNA, 635 bp, Homo sapiens
  misc_feature: GYAE6OF01BFD7K.8.67.G01.1.454.CMB.1.raw
  modified_base (370)..(370): a, c, t, g, unknown or other
  misc_feature (370)..(370): n is a, c, g, or t
tcagctcgcgtgtccacgaccggtgctcgatttagagtatacatattgggtttgggggcttttcctgggctcctgctactctggctccgaggtgtcagatgtgacatccagatgacccagtctccatcctccctgtctgcttctataggagacagagtcaccatcacttgccgggcaagtcagaccattagctaacctttttaaattggtatcaacagacgacccaaggaaaaccgaccccccaaaacttccctagtaattttacgtgggtgacactcctaagtttcgacgtaaaggtcggggtccatacgaaggttcagtggcaggtggatcgtggggcagtatttccaccctcaccatcgagcagtcncgacctaacgtgaagtactttgacttaacttactacgtgtacagctagttcttacgaggtaccgggccggtcctaccgtttgggaccggacggggacgaacggcgtagggacgtacgtacgaacgacgtggtacgcgtacgaccgaacctacgttccgttacgttaccttactaccgttcccgttaccccgactaccgttcgtacggaccgacgacggtccggacggtcgtagacgggccgggtacgtaggacgaacgggcgtac

SEQ ID NO: 101399 - DNA, 535 bp, Homo sapiens
  misc_feature: GYAE6OF01BFKN9.8.67.G01.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (336)..(336): a, c, t, g, unknown or other
  misc_feature (336)..(336): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacngagcccaaggaaaacncccccaaatcctgatttanggtncatccatttcgactaagtcgggtccatcaagttcagtgcagtgatcgtgggcagtacttccaccctcaccatcagcagtcngacaacgtgaagtcttgactaacttactactgtacagctagttctacgagtacggccggctacgttggaccgagggacagcgtagagacgtacgaacgtagtggtcgctacgacacattcgtcgtcttcacttccgtcccgactagtccgtagacgacgtacgacgcgcgtggacggcggacgtaggacgaggcgtacg

SEQ ID NO: 101400 - DNA, 655 bp, Homo sapiens
  misc_feature: GYAE6OF01DHN9V.8.67.G01.1.454.CMB.1.raw
  modified_base (264)..(264): a, c, t, g, unknown or other
  misc_feature (264)..(264): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattacgctaacctttttaaattggtatacaacagacgacccaaggaaaacgcccccaaactcctagtatttagtggtncactcctatttcgacgtaaaggttcgggtcccagtacgtaaggttcaggtggacgtaggtaggtatcggtggggacagtactttccacccttccgaccatcgacgactacgtctacgaccaactagaacgtactttacgactaacttactacgtgtacagtctacgttacttacgcggtaccgggccggtacctaccgttcgggaccggaagggacgtacgcggtagagtacgtacgaacgtacgtggtacgtcgtcgacctactacgttcgttacgttccttaccgttacttcccttaccccgtacctaccgtacgtacgaaccggtaccgtacggtacggtacgcggttacggaccgggtaccgggtcgtaggcggaacggcggtaacg

SEQ ID NO: 101401 - DNA, 506 bp, Homo sapiens
  misc_feature: GYAE6OF01D8QKV.8.67.G01.1.454.CMB.1.raw
  modified_base (251)..(251): a, c, t, g, unknown or other
  misc_feature (251)..(251): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaactcctgattttanggtgcatccatttcgcaaagtgggtcccatcaaggttcagtggcagtggatctggggcagatttcaccctcaccatcagcagtctgcaacctgaagactttgctaacttactactgtcagcagtcttacagtaggcccgggctaccgtttggccgaggggacgaagctgggagatcgaacgactgtggctgcacatcgtntcttcactctccgccntctgacgcncgcgcgctgcggcgggctgggcaggcgacg

SEQ ID NO: 101402 - DNA, 808 bp, Homo sapiens
  misc_feature: GYAE6OF01EBA3P.8.67.G01.1.454.CMB.1.raw
tcagctcgcgtgtccacgaccggtgctcgatttagagtatacatattgggtttgggggcttttcctggctcctgctactctggctccgaggtgccagatgtcgacatccagatcgacccgagtctccatcctccctgtctgcttctataggagacagagtcaccatcacttgccggcaagtcagacctattagctaacctttttaaatggtatcgaacagacgcccaaggtaaaacccgtcccccaaacgttccgtaggtacttttacgtaggtcgactacttcctagtttccgacgtaaaagggtccgggtaccccaagtaccgtaaacggttccacggtaccggtaccgtaaggttacggtacttcgggtacgggggtacctaacggtttactttacccaccccgttcctaaccgtagtaccgaacggtccgtaaccgttaccgttcggaaccctaaacccggttagggaaaaccgttaccgttttacggaaccttaaaacccgtttaactaccgtttacggttacctacgtacctacgtttaccgttaaccgtacggtaaccgggtcccgggtaccttaccggttttacggggacccgaagggggtaaaccgaacggtccgttaggtaacgttacgtaaccggtaacgtaacgtggtaccgactacgacctaccctaacgttccgtacgttcctttaccgaccgttcccgttacccgacttacgttacgaacgaccgtaaccgaccggtacggacgtacggtacggacgggtaccggtacgaccggtaacgtacggtccgtaacg

SEQ ID NO: 101403 - DNA, 619 bp, Homo sapiens
  misc_feature: GYAE6OF01AKUOL.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttatggtgcatccatttcgacaaagtcggggtcccatcaaggttcagtggcagtggatcgtggggcagatttccaccctcaccatcagcagtctgacaacctgaagtctttgacctaacttactactgtacagctacgttacttacgaggtacggccgggctaaccgtttcgggaccgtaagggggacgaagtcgtagggagtacgtaccggaaacgacgtggtcggctcggccaacctatccgttcgttctttacacgttcccttaccccggacctacgttccggaacgtacccgacggtaccggaacgtccggttacggacgggtaccgggtaccggttacgggacccgtaaacgggccgtcgtaaacgg

SEQ ID NO: 101404 - DNA, 598 bp, Homo sapiens
  misc_feature: GYAE6OF01E5QTG.8.67.G01.1.454.CMB.1.raw
  modified_base (347)..(347): a, c, t, g, unknown or other
  misc_feature (347)..(347): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaactcctgatttatggtgcactccatttcgcgaaaggtcggggtcccatcaaggttcaggtggcaggtggatcgtggggcagtactttcaccctcaccatcagcagtcngacaacctgaacgtactttgactaacttactactcgtcagctagttcttacaggtacggccgggtctaccgtttcgggaccgaagggggacgaaggtcgtagggagtacgtacggaacgtaacgtggtcggcgtcgccaccgtattcgtgttccttctacttcccgttccccgcctagttccgtaggacgaaccgaccggacggtcgcggtacggacgggtccgggcggtacgggaccggacgggcgacgg

SEQ ID NO: 101405 - DNA, 516 bp, Homo sapiens
  misc_feature: GYAE6OF01A5K0S.8.67.G01.1.454.CMB.1.raw
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
  modified_base (513)..(513): a, c, t, g, unknown or other
  misc_feature (513)..(513): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaactcctgattttatggtgcatccatttcgcaaagtgggtccatcaaggttcagtggcagtgatcgtggggcagntttcaccctcaccatcagcagtctgacaaccgtgaagtactttgctaacttactactgtcagcagtcttanagtaggccggctaccgtttggccgaggggacgaagcgtaggagtagtcgaacgactggtgctgcaccatcgtgtcttcactccttcccatctgacacgacgcgagcgagcggcgtcggacgaaggcgcngtg

SEQ ID NO: 101406 - DNA, 536 bp, Homo sapiens
  misc_feature: GYAE6OF01AKWEM.8.67.G01.1.454.CMB.1.raw
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaatcctgatttanggtncatccatttcgcaaagtgggtcccatcaaggttcagtggtagtggatcgtggggcagatttcaccctcaccatcagcagtctgccaacctgaagtactttgactaactttactactgtcagcagtcttacgagtacggccggtctaccgtttggccgtaggggacgagcgtaggagagtacgaacgaactggtggctgcacatcgtgttcttcacgttccttcccgctactcgtgacgacgacgcgagctaggacgcgggtcgtacgggacgacgggcgcgtag

SEQ ID NO: 101407 - DNA, 723 bp, Homo sapiens
  misc_feature: GYAE6OF01B34X0.8.67.G01.1.454.CMB.1.raw
  modified_base (178)..(178): a, c, t, g, unknown or other
  misc_feature (178)..(178): n is a, c, g, or t
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (439)..(439): a, c, t, g, unknown or other
  misc_feature (439)..(439): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctagtaggagacagagtccaccatcacttggccggnaagtcagaccattagctaacctttttaaatggtatacaanagacgaccaaagggaaaaccncccccaaactcctagtatttagtggtnactatcctatttcgagtaaggtcgggtacctatacgtaaggttcaggtcggactaggtaggagtcggttggggactaaggttactttacccaccctacaccctataccgagcctaagtctacgaacctaaccgtagaacttacgtttacgaccttaaacgttactagtcgtanaacgtcgtacgttacgttacgaggtacgggaccggtaccgtaccggtttacgggaccgaaggggtaacgaacggtcgtacgggaagtaacgtaccggaaacggtacgtcggtcggaccttacggacctaaccgtacgttcgttacgttacccgtattaacccgttcccgttacccgtaccttaacgtccgtaaccggtaacgtaccccgaaccggtccggtaacgtaccggttacgggaccgggtcccggggacgtaccggggaaacgacggggtccggtaacg

SEQ ID NO: 101408 - DNA, 540 bp, Homo sapiens
  misc_feature: GYAE6OF01EX1IC.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagccccaggaaaacgcccccaaactcctgatttatggtgcatccatttcgcaaagtgggtcccatcaaggttcagtggcagtggatcgtggggcaggtatttcaccctcaccatcagcagtctgcaacctgaagtactttgctaacttactactgtcagcagtctacagtacggccggcaccgtttggccgaggggacagcgtggagatcgaacgacgtgtacggctgcaccatcgttcgttcttcatccttcccgctactccgtacgacgaccacggcgaggccgtaggacggaccggggtctagggcgtaagggccgtacg

SEQ ID NO: 101409 - DNA, 618 bp, Homo sapiens
  misc_feature: GYAE6OF01CWWZQ.8.67.G01.1.454.CMB.1.raw
  modified_base (316)..(316): a, c, t, g, unknown or other
  misc_feature (316)..(316): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgtatttatggtgcatcctatttcgacaaaggtcggggtcccatcgtaaggttcaggtggcaggtggatcggnggggcagtactttccaccctcaccatcagccagtctcgctaacctgaaagtctttagactaacttactactgtacagtctagtcttacgaggtcggccggtctaccgttggcgagggcaagcgtagggactagtacgaacgtacgtggtcggctcgaccacgtattcgttacgttccttaccgtactttcccgttaccccgtacctacgttacccgtaggaaccgtaccggtaccggaccggtacgccgggttagggaccgggtcccggggtacgtacggggaacgaacgggtccgtaacgg

SEQ ID NO: 101410 - DNA, 714 bp, Homo sapiens
  misc_feature: GYAE6OF01B0RYU.8.67.G01.1.454.CMB.1.raw
  modified_base (265)..(265): a, c, t, g, unknown or other
  misc_feature (265)..(265): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgcccaaggaaaaccgccccccaaaactccctagtactttagtgggtncactcctatttccgacaaagggtcggggtacccagtccgaaggttcaggtggacaggtggatcggtggggacagtactttccaccctcacctatcagctacgtctacgacaaccgttagaacgtctttagaccttaaactttacctaacgttgtaccagtcctacggttaccttaacgacgggtacgggtcccgggtaccttaccggtttcggacccggtaagggggtaaccaaggtcggtagggaacgtacgtacccggaaacggtaccgtgggttacggccgttcggaccctaaacccgtcgtttccgtttacggttccctttaacccgacctttccccgttaccccgacctacgttaccgttaggaaccggaccgttaaccgggaccgggtcgtaccggtgggaacggggtcccgggtacgtacgggaccggaacggggctaccgg

SEQ ID NO: 101411 - DNA, 636 bp, Homo sapiens
  misc_feature: GYAE6OF01AKZZU.8.67.G01.1.454.CMB.1.raw
  modified_base (258)..(258): a, c, t, g, unknown or other
  misc_feature (258)..(258): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgcccaaggaaaacgcccccaaatcctagtatttagtggtnactatcctatttcgacaaaggtcgggtcccatcgaaggttcagtggcagtgatcgtggggcagtactttccaccctcactatcagcagtctgacaaccgtgaaacgtctttgactaactttactaacgtgtacctagcctagttaccttacgaggttacggccggtactaccgtttcgggacccgaggggtaacgaggtcgagggtacgacgtaccggaaagtaaccgtggttacgcgtacggacccaaccgtactcgttaccgttacttactacgttcccgttcccgacctagttccgtacggtaacgaccggtaccgtacggacggtcgttacgggacgggtccgggacgtaccgggacgaacgggtccgtaaccg

SEQ ID NO: 101412 - DNA, 655 bp, Homo sapiens
  misc_feature: GYAE6OF01C5IME.8.67.G01.1.454.CMB.1.raw
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
tcagctcgcgtgtccacgaccggtgctcgatttagagtatacatattgggtttgggggcttttcctgggctcctgctactctggctccgaggtgccagatgtgacatccagatgaccccagtctccatcctccctgtctgcttctataggagacagagtcaccatcacttgccgggnaagtcagaccattagctacctttttaaatggtatcaacagacgacccaaggaaaacgcccccctaaaactcctgtaattttagnggtagctatcctattttcgacgaaaaggtcggggtacccatacaaggttcaggtggcagtggatcgtggggcagtactttccacctcaacctatcagcagtctcgaccaaccgtgaaacgtacttttgaactaaaccttacgttactgtacacgtctaggttcttacgacggtacgggtaccgggtacttacccgtttcgggacccggtaagggggaacgtaacggtcggtagggaacgtaacgtacggaaccgtaacgttggacggtaccgtcgaccgtaacctacgttcgttacgttcttctaccttcccgttcccggacctacttaccgtcgacggtaccgaccggtacgtcgcgtaggacgggtcgggtacgtaggacgtgggccgtacg

SEQ ID NO: 101413 - DNA, 655 bp, Homo sapiens
  misc_feature: GYAE6OF01DAT09.8.67.G01.1.454.CMB.1.raw
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (336)..(336): a, c, t, g, unknown or other
  misc_feature (336)..(336): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgctttctataggagacagagtcaccatcacttgccgggcaagtcagaccattagcctacctttttaaatggtatcaacagacgccccaaggaaaacncccccaaaactcctgatttanggtncatccatttcgacaaagtcgggtcccatcaaggttcagtggcagtggatcgtgggcagtattcacctcaccatcancagtctgacaactgaaacgtctttgactaacgttactactgtacagactagtcttaacgaggttacggcccgggtactaccgtttcgggaccgaggggtaacgaaggcgtagggacgtacgtaccgaaacgtacgtggtacggtcctggacctacctagttaccgttgttacccttacgtaacctttcccgttacccccgtacctaacttcccgttacgggaaccgaacccggtaacccgggaccggtaacgtaccggttagggaaccgggtccgggggtaccgttacggggaacccgtaaaggggtcccgtaaaccgg

SEQ ID NO: 101414 - DNA, 586 bp, Homo sapiens
  misc_feature: GYAE6OF01EZ8IC.8.67.G01.1.454.CMB.1.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaaccttttttaaatggtatcaacagagccccagggaaaacncccccaaatcctgatttanggtncatccatttcgcaagtgggtcccatcaaggttcagtgcngtggatctggggcagtatttccaccctcaccatcagcagtctgacaaccttgaagtactttgctaacttactactgtcagctagttcttacaggtacggccgggctaccgtttcggacccgtaaggggacgaaggtcgtgggagacgtaccgaacgacgtggtcggctcgacacctacgtcttacgttcttcgacttcccgttaccccgcccttatccttcggaaccgtaccgaccggacgaacggccgtacggacggtaccggggtcgtagggaccggaaggccggacg

SEQ ID NO: 101415 - DNA, 650 bp, Homo sapiens
  misc_feature: GYAE6OF01DUW3U.8.67.G01.1.454.CMB.1.raw
  modified_base (156)..(156): a, c, t, g, unknown or other
  misc_feature (156)..(156): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagaaagngtcaccatcacttgccgggcaagtcagaccattagctacctttttaaatggtatcaacagagcccaagggaaaacnccccctaaaatcctgtatttagnggtncatcctatttcgcaaagtgggtcccatcaaggttcagtgcagtggatcgtggggcagatttcaccctcaccatcagcagtctgacaacctgaagtactttgactaacttactactgtacagtctaggtcctttacgacggtacgggcccgggtactaccgtttcgggacccggtaaggggaaccgaaggccgtgggtaacgaacgtaccggaaacgtaaacctgggtacggacttgaccctaacctaattccgtcgttaccctttaccgacgtttacccgttcccccggtacctaacgttacccgttaggaaccgaaccgaccggtaccgtacggacccgttgggaacgggtccggggtaccgtcggggaccaaacgggtccgcgtaaagg

SEQ ID NO: 101416 - DNA, 977 bp, Homo sapiens
  misc_feature: GYAE6OF01BUYM6.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgaccccaaggaaaaccgccccccaaaactcccgtagtattttacgtgggtacgacctacttccctaagttttccggacgtaaaacgggttccggggggttacccctaattaccgtaaacgggttttaccaagggttcgggacctaagggttacggggaacgttccgggttacggggggggacctaaacgggttacttttttaccccgaaccccccttaccaacccctaacgttaccgtaacggtacccgtaaacggtttcccgtaccgggaacccctaaaaccccggtttaaggggtaaaaaccgggtttaaccccttttttacggggaaaccccctttaaaaccgtttttaacctttaacccgtttacggtaccgtaacggtacccgttaaacggttttacccgtttaaccggtaacggggttacccgggggtaccccggggtacccgttaacccgggttttccggggaaccccgggtaacggggggtaaccggtaaacgggtccggttacggggaacggttaaccggtaaccgggtaaaaccggtacggtttacgggttaccgggtaccgttacggtacccgtaacccgttacgtttaccgtttaccggtttacctttacccgtaccgtttaccccgttacccccgtaccttaaccggttcccgtaacggaaccggtaacccgtacgggacccggtacggtccggtacgggaccgggtccggggtacggtaccgggaaccggtacgggccggtaacg

SEQ ID NO: 101417 - DNA, 674 bp, Homo sapiens
  misc_feature: GYAE6OF01BRH8P.8.67.G01.1.454.CMB.1.raw
  modified_base (153)..(153): a, c, t, g, unknown or other
  misc_feature (153)..(153): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgctttctataggganacgagtacgtccacctatactacgtcggccggactagtacgacgactagtacgtacttttaacttttaagtagtactacaacgagaccgaccgaaaggaaacccaaccctaactcgtagttattgtgtcactactacttagttcgaagtaacgggtccggtacctagtacgtagtcgaggtcgacgtaggtagtcgtcgggaggactattacctacccgacctacaactagtacgacgtacgtactcgacgaaccgtaagtacgtaacgttcttacgaacctttaactacttacgtcgacgtactaacgtacgtttactacggtacggtacccgggaccgtaccgttcggtacgggaacggacgggacgacgtgtaggacgtacgaacgtacgtgtcgtcgaccgtacgaccacgtgtccgttacgttctaccgttcttcccgtccgtacgtcgttcgtaagaccgtaccgcggtacggtcgtccgtagggccggtcgggacgtacggaacggcggcgtag

SEQ ID NO: 101418 - DNA, 700 bp, Homo sapiens
  misc_feature: GYAE6OF01BOU5S.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaattggtatcaaacagacgacccaaggaaaaccgacccccaaactcctagtattttagtggtgactacttcctagttttccgactaaaggtcggggtacccagtacgtaaggttccaggtggctaggtggacgtcggtggggctagtactttccaccctacaccctatacagtcacgtctacgaccaacgtagtaacgtactttgaacttaacgttacttacgtagtaccagtctacgttacttaacgtacggtacggcccggtacttaccggtttcgggaccggacggggtaacgacggtacgtagggacgtacgttaaccgaacgtaacgtggtacggctacggaccaaccgttacgttcgttacgtttacctttacgtaccgtttcccgttacccggtaataccgttaccgttaacggaccgtaacccgaccggtcggaccggtcggtacgggtacgggtcccgggtaggtaccgggtaacgacgggtcgaacg

SEQ ID NO: 101419 - DNA, 577 bp, Homo sapiens
  misc_feature: GYAE6OF01AP1PC.8.67.G01.1.454.CMB.1.raw
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagactacctttttaaatggtatcaacagagcccaaggaaaacgcccccaaatcctagtatttagnggtgctatcctatttcgactaaaggtcgggtacccatcaaggttcaggtggactagtggatcgtgggcagtatttccaccctcacatcgagcagtcngacaactgaatcttgactaacttactctgtacagctagttactacgaggtacggccggtactaccgttcggaccggaagggacgtaggcgtagggacgtacgtaccggaacgtacgttggcggtactcgtaccaaccgtagttccgttcgttcttacaccgttcctcccgctactcgacgacgacgacgcggcgccgtgacggtcggcgtaggccgagggcgtacg

SEQ ID NO: 101420 - DNA, 570 bp, Homo sapiens
  misc_feature: GYAE6OF01CBATE.8.67.G01.1.454.CMB.1.raw
  modified_base (334)..(334): a, c, t, g, unknown or other
  misc_feature (334)..(334): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctactttttaaatggtatcaacagacgacccaaggaaaacgcccccaaaactcctagtatttagtggtgcatccatttcgacaaagtcggggtacccatcgaaggttcagtggcagtggatcgtgggcagtatttccaccctnaccatcagcagtctgacaactgaagtactttgactaacttactactgtacagtctagtcttaacgaggtacggcccggactaccgttgggacccgtaaggggacgaagcgaggagatacggaacgtaacgtcggtgactcgaccactgttcgtgttacttcgacttccctcccgctagttccagacgtaccgacgcgacgcgtaggaccggcgggtactagggacgtaggcgtacg

SEQ ID NO: 101421 - DNA, 753 bp, Homo sapiens
  misc_feature: GYAE6OF01DRZ57.8.67.G01.1.454.CMB.1.raw
  modified_base (258)..(258): a, c, t, g, unknown or other
  misc_feature (258)..(258): n is a, c, g, or t
  modified_base (734)..(734): a, c, t, g, unknown or other
  misc_feature (734)..(734): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttggccggcaagtcagaccattagctactttttaaatggtatcaacagacgacccaaggaaaaccgccccctaaaatcctagtattttagngggtcactatccctattttcggaacgtaaaggttcggggtaccctagtacgtaacgggtttcaaggtcgggtcaagggttggaacttcggtacgggggacctagttaccttttaccgaaccccttacaacccaacttccgaacggtctaacggtttcctaccggtaaccaaacccgttaggaaaaggttaccttttacggaaccttaaaacctttacttacggttactaccggaactccggtaaagttccgttaacgtacgggaccggggttacccgggaccgttacccgggtttcgggaccggtaacgggggtaacgaaggcggttagggaacgtacggttaccgaaacggtacgtggacggtcgtacgaccaccgttacgtccgttagttacccttacgtccgttcccgttccccgacttctaccggtaacgacgttaccgacggcgtaccggtcgaaggtcgggccggtacgngggtacgacggcggtaacg

SEQ ID NO: 101422 - DNA, 776 bp, Homo sapiens
  misc_feature: GYAE6OF01A93ZC.8.67.G01.1.454.CMB.1.raw
tcagctcgcgtgtccacgaccggtgctcgatttagagtatacatattggggtttgggggcttttcctgggctcctgctactctggctccgaggtgccagatgtgacatccagatgacccagtctccatcctccctgtctgcttctataggagacagagtcaccatcacttggccgggcaagtcacgaccattacgcttaacctttttaagttggtatacaacagacgaccaaggaaaccgacccccaaactcctagtatttagtggtgacctatcctatttcgacgtaaaggtcgggtacccatacgtaaggttcaggtcggctagggtggagtcggtggggacaggtactttaccacccctacacctactcgaacgtcgtacggtctacggtaccgtaacccgttaagaaacggttacctttacggaaacccttaaacctttaaccgtaccgtttacgttaccgaacggttaccgtaacgttaccgtttaacgagggttaaccgggtcccgggtaccgttaccggtttaccggggaccgggtaacgggggtaaccggtaaacggtcggtacgggtaacggtaacggtaccggtaaacggtacgttacggtacggtccgtacgaaccttaccgtaacgtccgttcgttaccttacgtaccgttccctacccgtagtaccgtaccggtacgtaaccggaccggtacggttacggcccggttaggtaccggggtacggtcccggggtacggtacgggtaacggccgggtcggtaacgg

SEQ ID NO: 101423 - DNA, 528 bp, Homo sapiens
  misc_feature: GYAE6OF01DMRX8.8.67.G01.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (473)..(473): a, c, t, g, unknown or other
  misc_feature (473)..(473): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaactcctgatttanggtncatccatttcgcaaagtcggggtcccatcaagtcagtggcagtgatcgtggggcagctttcgaccctcaccatcagcagtctgacaactgaagtactttgactaacttactactgtcagacctagtcttaacaggtacggccggtctaccgtttggcccgaaggggacgaagcgtgggagtagtacgaacgactgtggctcggcaccatctcgtcttncttctcccgctatctagagacacgcgacgcgtgacggcgggactggcagggcacg

SEQ ID NO: 101424 - DNA, 801 bp, Homo sapiens
  misc_feature: GYAE6OF01CWU4X.8.67.G01.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagtatacatattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgcccacctctctgtgcgcagtcagagtcgttagacgtacttgcgtgtatcagcaggacggcctcggccacgggccctcccgaggtacccttcctactacgtttccgtttcgggacccgttacccgttttaaacggacggggtaccctaggtacggaaccttaccccgagtacccgtaggttaccgacggccggacgttacggttggggtcgttacggggtacctttcggtaccaccttcctaccgacccttaaagtacctaaaacttacccgtgtaacctaacgttaccgtacgtaaccgtttacgtttcgtacgttttaacgtttttacttcgttacggaccttaggtccgtaacgtttcgtaagtaacggttccgttacggggttacccttttaccggtaccgggtttaccggggaccgggtaaaccggggtaaccggtaacgggttacccggtaaccgttaaccggtaaaaccggttaacgtcggggtacgtaaccggttaccggtaacctaacccgttcgttacccgtttacgtttacccgtttacccttaaccgttacccccgttttccccgaccgtttaacgttaccggg

SEQ ID NO: 101425 - DNA, 647 bp, Homo sapiens
  misc_feature: GYAE6OF01CK19P.8.67.G01.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagctcgcgtgtccacgaccggtgctcgatttagagtatacatattggggtttgggggcttttcctgggcctcctgctactcctggctccgaggtgccagatgtgacatccagatgacccagtctccatcctcctgtctgcttctataggagacaggagtcaccatcacttgccgggnaagtcagaccattagctaccgtttttaanggtatcaacngacgcccaaggaaacnccccaaatcctagtatttanggtnactatcctatttcgacgtaaaggttcggggtacccagtacgaacggttcaggtggcaggtggatcgtggggcaggtactttcaccctcaacctatcagcagtctgacaactgaacgtctttgactaacttctacgtgtacagtccagttctacgagtacggccggtctacgttcggacgtaggggactaaggcgtagggacgtagaccggaacgtaacgtggtaggcgtacgtaccaccgtatcgttcgttacgttccgtaacgttcccgttacccggccttagtccggtaggtaaccggtacccgtacggtaccggtacggtcccgggttaagggaccggggtccgggttaccggtaggggaccccgtaaacggggtcccgtaaacgg

SEQ ID NO: 101426 - DNA, 594 bp, Homo sapiens
  misc_feature: GYAE6OF01EY86G.8.67.G01.1.454.CMB.1.raw
  modified_base (256)..(256): a, c, t, g, unknown or other
  misc_feature (256)..(256): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgtatttagtggtncatcctatttcgacaagtgggtccatcaaggttcagtggcagtggatcgtggggcagtactttcaccctcaccatcagcagtctgacaacctgaactactttcgactaaactttactacttcggtacagtactagttaccttacgtaacggtacgggtccgggtacgtacccgttttgggacccggacggggaacgtaacgcgtagggaacgacgtacggaacgtacgttcggtggctcgacctacctattcgtacgttcttacctcgttcctcccgctacttcgtacgacgacgacgcgacgcgtaggacggccgggacgtacggacgcggcgtacg

SEQ ID NO: 101427 - DNA, 745 bp, Homo sapiens
  misc_feature: GYAE6OF01EKM9U.8.67.G01.1.454.CMB.1.raw
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccggcaagtcagacctattacgacttacttttaaatggtanactaacagacgacccaaggaaaccgcccctaaactctagtatttgnggtcactacttctagttacgacgtaaacggtcgggtacctagtacgtaaggttaccgaggtcggacgaggtggtacttcgggtacggggactaggtacctttccgaccccgttacgacctactaccgagtacgtacgttacgtacgaccgtaaaccgttagtaaacgttacgtttacgaacctttaaccttaacctacgtcgtacgaaggtacctacgtttactaaccggtaggtaccgggtcccggtacgtacccggtttgggacccggtaaacgggacgtacgtacggtacggtaacgtacgaaccgggtaataacgttgggtacgtacgtcgtaacccacgttaccgttcctacggttccttaccgtacgtttaccccgtcccgtaacgtacgttccggaaaggtacccggacccgtagggtaccggtccgacggttaccgggaacggtcccgggttacgaccgggtaacgtcggtacgtaacgg

SEQ ID NO: 101428 - DNA, 636 bp, Homo sapiens
  misc_feature: GYAE6OF01B4KI3.8.67.G01.1.454.CMB.1.raw
  modified_base (251)..(251): a, c, t, g, unknown or other
  misc_feature (251)..(251): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaatcctgatttanggtgcatccatttcgataaagtgggtcccatcaaggttcagtggcagtggatcgtgggcagtatttcaccctcaccagtcagtcagtctgacaactgaacgtactttgactaaacttactaactgtacagctagttactttaacgaggtacggcccgggtacctaaccgtttgggacccgaaggggaacgaaagtccgtagggaacgaagttaccggaaacgtaacgttggtagggacctcggacccaaccgtacttccgttacgtttcctttaccgaactttcccgttaccccggctaacgttccttaggaaccgaccgaccggcggtacggcccgttagggaacggtcccggggtactaggggacccgtaaagggccgtaacg

SEQ ID NO: 101429 - DNA, 721 bp, Homo sapiens
  misc_feature: GYAE6OF01C0D74.8.67.G01.1.454.CMB.1.raw
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctagtaggagacagagtcaccatcacttgccgggcaaggtcagacctattagactactttttaaatggtatacaacagacgcccaaggaaaacncccccaaatcctgtatttagtggtcnctatcctagtttcgacgtaaacggtcggggtaccctagtaccgtaaggttacaggtcggacgtaggtaggtacttcggtcggggtacctaacggtactttcccgaaccctccaacctactcgacgtcgtacgtctacgtaccaacgttaggtaaagttacgtttacgtaaccttaaccttacgttaccgtagttacgaacgtcgtacgttaccgttacgagggtaccgggcccgtacgttaccgttacggggaacccggtagggaaccgtaaacggtccgttaagggacgtaacgttaacccggaacgtaacgtttcggtacggtacgttacggtacctacgtacgtttcgttccgttacgttaccgtaaccgttcccgttaccgaccgttagtccgtacggacgtaccgcggtacgtcgccgtaggacggtccgggtacgtcgaacggagtcgtaacg

SEQ ID NO: 101430 - DNA, 780 bp, Homo sapiens
  misc_feature: GYAE6OF01DGCEY.8.67.G01.1.454.CMB.1.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggacaagtcagacctattagacttaacctttttaaagtggtatacaacagacgcccaaggaaacnccccctaaactcctagtatttagtggtnactattcctagtttaccgacgtaaaggtccgggtaccctaatcgtaacggttcaggtggactaggtggtatccggtgggactacgtactttcccaaccctcgaacactccgacgtctacgttcgtacgaacctaaccgtagtaacgttactttacgaaccttaacgtttactacgttcgtacgtaacgtacgttacgttaccgttaacggacggttaccgggtacccggttaccgttaacccgggtttcggggaacccgggtaacgggggaaccggtaacggtacggtaacgggtaacggtaacgtaaccggaaaccggttaggttcggtacggaccgttacgaacccgtaaccttacgtttccggtttactttacccttacgtttacccgttccccggtaccccttagtaaccgttccgttaacggaccggttaccggacccggacggtccgtacggtagggtaacccgggtcggggtacccgtacgggaacccggtaagggtcccgtaaggg

SEQ ID NO: 101431 - DNA, 771 bp, Homo sapiens
  misc_feature: GYAE6OF01B7A24.8.67.G01.1.454.CMB.1.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagacgtcaccatcacttcggccgggacaagtcagaccattacgcttaactttttaaatggtatacaacagacgacccgaagggaaaaccnccccctaaactcctagtatttagtgggtnactactacctacgtttacgacgtaaacggtcggggtaccctacgttaccggtaagggtttccgaaggtcgggacgtaagggttacgggtacgttaccgggttcggggggactaacggttaccttttaccccgaacccctaccaacctacgtacgacgtacgtacgtctacggtacctaacgtacggtaaacgttcgtttacgaccttaaactttacctaacgttcgtacgtacgacctagttaccgttacggtaacggtacgggtacccgggtacgttaccggttacggggaaccggaaggggtaaccggtaacgggcgtagggaacgtagtaaccgaaacggtacgtcgggtacggactacgacctaacgtcgttacgttctacgttaacctccgttacccgttacccgtaccgttactaccggtaacgaccgacgtacggacggtacgcggttacgggacgggttcggggacgtacgggaacgtagggtcccgaagg

SEQ ID NO: 101432 - DNA, 649 bp, Homo sapiens
  misc_feature: GYAE6OF01DPH22.8.67.G01.1.454.CMB.1.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (338)..(338): a, c, t, g, unknown or other
  misc_feature (338)..(338): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaaacagacgaccccaagggaaaaccgccccccaaaacttcctagtaactttttagngggtacncctaatcctatttcggacaaaggttcgggtacccatcgaaggttcaggtggcaggtggatcgnggggcagtatttccacctcaccatcagctagtctgacctaacctgtaaacgtctttagaccttaaactttactacgtcgtacacgtacgtacgttacttacgacgggtaccgggcccggtactaccggtttcgggacccggtaaggggaacgaagggtccgtaggaacgtacgtaccggaacggtacgtggtcgtacgtacgacctacgtacttccgttacgttccgttctacgttcccgtacccgctacgttcgacgacgaccgacggcggcgcgtggacgggtcggacgtacgggacgacggtcgtacg

SEQ ID NO: 101433 - DNA, 685 bp, Homo sapiens
  misc_feature: GYAE6OF01C2XOF.8.67.G01.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
  modified_base (528)..(528): a, c, t, g, unknown or other
  misc_feature (528)..(528): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgtcttctataggagacagagtcaccatcacttgccgganaagtcagaccattacgacttaactttttaaatggtatacaaacgagacgacccgaaggaaaaccgcccccaaaacttccgtagttaatttagtggtcnctacttcctatttcgacgtaaaggtccgggtaccagtaccgtaaggttcaggtcggacgtaggtacgggactcggtagggactagtacctttccacccgtcaacctatcagctacgtctacgactaactagaaacgtctttacgaacttaacttacgtctgtacaagcttatacttacggtacggtacgggccgtactacggttcgggacgtaacggggacgtagcggtagagaacgtaccgaagtgtacggngactcgaacctacgtcttacgtcgtttccttacgtacccttcccgttacccgaacgttaacgttccggtacgaaaccgttaacccggaccggtacggtaacgggtccggttaacggcggggtacccggtacggtaccgggaacggaccgtcggaacg

SEQ ID NO: 101434 - DNA, 620 bp, Homo sapiens
  misc_feature: GYAE6OF01BJEYG.8.67.G01.1.454.CMB.1.raw
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagagcccaaggaaaacgccccaaaactcctagattttanggtgcatccatttcgacaaaggtgggtcccatcaaggttcagtggcagtgatcgtgggcagtatttcaccctcaccatcagctatctagacaaccgtgaaagtactttgactaacttactactgtcagtacagttctaacagtacggccggctaccgttggaccgaagggggaccgaagcgtagggaagtactacggaacgtaacgtggtaggacttacggaccaaccgtacgtccgtttacgttactttaccgtaaccttcccgttacccccgctaacttacgttacggaaccgacgtaacccggcggtaagtaccgttggggaaccggtcgggggtacttacggggaacaacggggccgtaacc

SEQ ID NO: 101435 - DNA, 827 bp, Homo sapiens
  misc_feature: GYAE6OF01B67X3.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattacgctaacctttttaaattggtatacaacagacgacccgaaaggaaaaccgcccccctaaaaacttcctagtaatttttacgtgggttacgctaacttccctagttttaccgacgtaaaacggtcggggtaccctataccgtaagggttcaggtcggcaggtggatcggtggggacagtactttcccaccctacaacccatacgagcctagtctcggaacctaaccgtaggaaacgttaccttttacggaacctttaaaccttttaaccgtaaccgttcgttaacgaacggtacttaaacggttttcccgttaaacggtaccggggttaaccggggtaccccgggttaccttaacccgggttttcggggaacccgggtaaacggggggtaacctaaacgggtccggaacggggtaacggtaaccgtaaccgggtaaaccggtacggttacggggtacgggtaccttacgggtaccctaacccgtacgtttacccgttaccgttacccgtttactaacccgtttccccgtaccccgtaccctacgttcccggtacgtaaccggaccggtacccggacggttcggaccggttcgggaccgggttcccgggacggtaccgggaaccggagggtacccgtag

SEQ ID NO: 101436 - DNA, 773 bp, Homo sapiens
  misc_feature: GYAE6OF01DB7LO.8.67.G01.1.454.CMB.1.raw
  modified_base (273)..(273): a, c, t, g, unknown or other
  misc_feature (273)..(273): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgtcttctataggagacagagtcaccatcacttcggccgggcaagtcacgacctattacgtacttaacctttttaagtggtatacaacagacgaccgaaggaaaccgacccctaaacgtcctagtatttagtggtnctactacctattcgacgtaacggtcgggtaccagtacgtaaggttcgaggtcgacgtaggtaggacgtcggtacggggctaacggttacctttaccaccctacaaccacgtcgacgtacgtacgttcgtacgaaccgtaaccgtaggtaaccgttcttacggtaacctaaccgtttactaccgtagtaccgacgtacgtacgttacgttaccgggaagggtacccgggtacccgggtaccgtttaacccggtttcggggaaccgggtaaacgggggacggtaaccgggtaagttcggggtaaacgtaacggtaaccgggtaacggtaggtccgggtacggggtctaccgggtaccctacgtaccgttcttaccggttaccttaccgttacccgttccccgttaccgttaccgtaccgttccggaagtaaccggacccttacggggacgtaccgtcggtaacgggccgggtacggtacgagggtaaccgcgggtacaccgg

SEQ ID NO: 101437 - DNA, 695 bp, Homo sapiens
  misc_feature: GYAE6OF01ALZ89.8.67.G01.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagacgcccaaggaaacncccccaaatcctgatttagnggtncatccatttcgacgaaaggtcgggtacccatcaaggttcagtggcagtggatcgtgggcagtactttccacctcaccatcagcagtctgacctaaccgtagaacgtactttcgacttaaaccttacctaacgtgtaccgaagtcctaagttaccgttaacgacggtaccgggtcccgggtaccttacccgggtttacgggacccggtaagggggaaccgtaaaggtccgtaagggacgtaacggtacggaaacggtaaccggtggtacggaccgtacgtaccgaaccgtacgttacgttcggttaccttcctaaccgtttccccgttaccccgtacctaaccgttcgtaacggtaaccgacccgacggtccggtaacggtccgggtacgggaccggggtacggggtaccggtacggggaaccgtacggggcggtaaccg

SEQ ID NO: 101438 - DNA, 665 bp, Homo sapiens
  misc_feature: GYAE6OF01DNQN9.8.67.G01.1.454.CMB.1.raw
  modified_base (238)..(238): a, c, t, g, unknown or other
  misc_feature (238)..(238): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagactacctttttaaattggtatacaacagacgacccgaaggaaaaccncccccctaaaactcctagtatttagtggtgcatcctattttcgacgaaaggtcgggtcccatcgtaaggttcagtggcaggtggactcgtggggcagtactttccaccctcaccgatcagcagtctgaccaacgtgaagtactttgacctaactttacgtactgtacacgtctacgttcttaacgaggtaccgggcccggtaccttaccggtttcggggacccggaagggggtaaccgaaggtccgtagggaagtacggtaaccgaacgtaacgtggtcggcttaggaccacctagttccgttagtttccctttacgtacctttacccgttacccgtaccttaactccgtacggaaacgtaccgaccgggtacggcggtcgtacggaaccgggcggggtacccgtaggggacgaacgggcgtaaacg

SEQ ID NO: 101439 - DNA, 622 bp, Homo sapiens
  misc_feature: GYAE6OF01CAYR3.8.67.G01.1.454.CMB.1.raw
  modified_base (156)..(156): a, c, t, g, unknown or other
  misc_feature (156)..(156): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagaaagngtcaccatcacttgccgggcaagtcagaccattagctaacctttttaaatggtatcaacagagcccaaggaaaacncccccaaaatcctagtatttanggtncatccatttcgacaaagtggggtcccatcaaggttcagtggcagtggatcgtggggcaggtactttccaccctcaccatccagctagtctgacaacctgaagtactttgactaacttactactcgtacagctagtcttacaggtcggtccgggctaccgtttggaccgaggggacgaaggctaggagtacgtacggaacgaacgttggtggtactacggacctaacctacgttccgtcggttacttccttaacgttcccttccccgaccgtaacgtccgttacggaacggtcgtaaccgggccgacgtccggttgggaacggtcccggggtcgtacgggaacggtaacgggccgtacgtaacgg

SEQ ID NO: 101440 - DNA, 688 bp, Homo sapiens
  misc_feature: GYAE6OF01BANBO.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacgttgccgggcaagtcagaccattagcttaacctttttaattggtatacaacagacgacccaaggaaaaccacccccaaactcctgtattttagtggtgctatacctagtttacgacgtaaggtcgggtacccagtacgtaaggtttcaggtaggctaggtggtacgtcggtggggactacggttactttacccacccttacaccgtactacgagtcaggtactcgacctaacgtagtaagtactttacgaacctaactttactactgtacagtactacgttacttaccggaggtaccgggccgggtaccgttaccggttacgggaccggtaaggggacgtaagtcggtagggagtacgtacggaacggtacgtggtcggtactcggaacctaccgttagttaccgttacgtttccttacctaccgttcccctacccgtactaacgtccttacggacgacccgtagggaccgtcgggaccgtgggaccgggtccgggtacgacgggacgaacgggtcgtacg

SEQ ID NO: 101441 - DNA, 779 bp, Homo sapiens
  misc_feature: GYAE6OF01BLC0I.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacgttggccgggcaagtcagactattagcttaacctttttaatggtatacaacagacgacccgaaggaaaccacccccaaacttcctagtaacttttagtggtacgactactcctaagtttaccgacgtaaagggtccggggtaccagttacgtaaggttcgaggttggaccgtaggtaggagttcggtagggggtactacggttactttcccgacccttacaccgagttacgacgtcgtaacgtccgtacggaccctaacgttacggtaacgttacgttttacgaacctttaaaccgtttacgtaccgttacggtactacggtaaccttaacggttacgttaacggtaacgggttaccgggtacccgggtacgttaacccgggtttacgggaccgggtaaacgggggaaccggtaaacggtccgggtaacgggaacggtaacgtaccgggtaaacgtacggttacgggtacggtaccgtacggtaccctaaccggttacttccgttacggtttaccttacgtaccgttaccctacccggtactacgttcgtacgacgtaccgacgtcggaacgcgtagggaccggtcgggtacagggaccgacggtcgtaacg

SEQ ID NO: 101442 - DNA, 665 bp, Homo sapiens
  misc_feature: GYAE6OF01C2ZX4.8.67.G01.1.454.CMB.1.raw
  modified_base (177)..(177): a, c, t, g, unknown or other
  misc_feature (177)..(177): n is a, c, g, or t
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (592)..(592): a, c, t, g, unknown or other
  misc_feature (592)..(592): n is a, c, g, or t
  modified_base (617)..(617): a, c, t, g, unknown or other
  misc_feature (617)..(617): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcacatcacgttggccgggnaagtcagaccattagactaacctttttaaatggtatcaacagacgacccaaggaaaaccncccccaaaactcctagtattttagnggtanctattccctagtttaccgacgtaaaggtccgggtaccataccgtaaggttcaggtggactagggtggtagtcggtggggactaagttactttccgaccctaccaacctatacgacgacgacttaccgacgaacctaaccgttaggaaattacgtttaacgacttaaacctttaccgagttcgtactagtcctaagttactaacggtacggtaccgggtcggtaccgttacggttcggaccggtaacggggaacgtaggacgtagggacgacgtaacggaacgtacgtcggtcgactacgcaacctgtactctactctaccttccncccgtactacgtcgacgacgaaccnggacgacgtccgtagggacggtaccggcgtagggcgtaacgcgtaacg

SEQ ID NO: 101443 - DNA, 665 bp, Homo sapiens
  misc_feature: GYAE6OF01C74VB.8.67.G01.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccggcaagtcagaccattagctaccttttttaaatggtatcaaacagacgcccaagggaaaacgccccccaaatcctagatttanggtncatccatttcgcaaagtcgggtcccatcaagttcagtggcagtagatcgngggcagtatttccacctcaaccatcagcagtctcgactaaccgtgaaagtccttttgactaacttactacgtgtacaggctagttccttacgaggtacggccgggactacgttgggaccgtaggggacaaggcgtagggagacgtacggaaacgtaacgttggtacggtacgtcgacccgtaacctaacggttccgttcggtttaccctttaccgtaaccgttttcccgttacccccgggtaccctaacggtttcccgttaacggaaccggtaacccggttaccggaccgggaccgtacggttacgggaacggggtcccgggtacggtacgggtaccgaaacggggtccgtaaccg

SEQ ID NO: 101444 - DNA, 805 bp, Homo sapiens
  misc_feature: GYAE6OF01DC0WM.8.67.G01.1.454.CMB.1.raw
  modified_base (302)..(302): a, c, t, g, unknown or other
  misc_feature (302)..(302): n is a, c, g, or t
tcagctcgcgtgtccacgaccggtgctcgatttagagtatacatagttgggtttgggggcttttcctgggctcctgactactctggctccgaggtgccagatgtgacatccagatcgacccagtctccatcctccctgtctgtcttctagtaggagactaggagtcaccatcacgttcggccgggacaagtcagacctattacgtaccttaacctttttaaagtggtaatacaaacgacgaaccgacccgaaacgggaaaacctacccccctaaacttccgtagttaattttagtgggtacnctaacttccctaagtttaccggacgtaaaacggggtccggggtacccaagttaccgtaaagggttccgtaagggttcgggacgtaagggttacgggtaacggttccgggtaggggggtacctaacggtttaccttttaccccgaacccccgtacctaaaccgtacttaccggacgtaacgtacgtttcgaacgtaacccgtaaacgttacggtaaacgtttacttaccggtaaccttaaactttacctaaggttcgttaccgaacgccgtttaacgtaccgtttaaccgggacggtacccggggaccgggttacccttaccgggttggaacccgggaaggggtaactacgggcgtagggaacgtacgtaaccggaacttacgtggagcctaggacctacgtcgttacgttcgtacttctacctcccgttaccactgtaccagtacgacgtccggacgtggccgtacggggacggtccgggtacgtcggaacgggcgtcgtacg

SEQ ID NO: 101445 - DNA, 570 bp, Homo sapiens
  misc_feature: GYAE6OF01EYTT4.8.67.G01.1.454.CMB.1.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgcccaaggaaaacgcccccaaatcctgattttagnggtncatccatttcgnaaagtgggtcccatcaaggttcagtggcagtggatcgtggggcagntttcaccctnacatcagcagtctgacacctgaagtacctttgactaacttactactgtacagtcaagtcttaacgagtacgggtccggctaccgtttgggacccgtaaggggaacaaggcgtaggagtagtacgaacgtagtggtcggctgcctacagtcgtcgttaccttgaccttaccttcccgcctagttacctaggtaccgaccgtagcggtaacgcgtagacggtccgggcgtaggccgaagggccgacg

SEQ ID NO: 101446 - DNA, 558 bp, Homo sapiens
  misc_feature: GYAE6OF01B25PU.8.67.G01.1.454.CMB.1.raw
  modified_base (336)..(336): a, c, t, g, unknown or other
  misc_feature (336)..(336): n is a, c, g, or t
  modified_base (528)..(528): a, c, t, g, unknown or other
  misc_feature (528)..(528): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaactttttaaatggtatcaacagagacccaaggaaaacgccccccaaatcctgtatttagtggtgcatcctatttcgacaaagtggggtacccatcaaggttcagtggcagtggatcgtggggcagtactttcaccctcaccntacagcagtctagactaaccgtgaagtacgtttgacgtaaactttactactgtcagtctagttcttacgagtacggaccgggtctaccgtttcggaccgagggacgaagcgtggagagtacgaacgacgtgtggctgccacctagtcctagttcttacgtactccgttcccgctactcagacgacacgacgngcgtgaggccgggagtaggacgaggtgacg

SEQ ID NO: 101447 - DNA, 547 bp, Homo sapiens
  misc_feature: GYAE6OF01EV9ZE.8.67.G01.1.454.CMB.1.raw
  modified_base (256)..(256): a, c, t, g, unknown or other
  misc_feature (256)..(256): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
  modified_base (514)..(514): a, c, t, g, unknown or other
  misc_feature (514)..(514): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaaagtcagaccattagctacctttttaaatggtatcaaacagacgcccaaggaaaaacgcccccaaactcctgattttanggtgcatccatttcgacaaagtgggtcccatcaagttcagtggcagtggatcgtggggcagtntttcaccctnaccatcagcagtctgacactgaanactttgctaaacttctactgtcagcagttcttaacgaggtacggcccggactaccgtttggcccgtaagggacaagcgtagganatacgaacgtaacgtgcgctcgcaaccagtctgttccttnacttccttccccgctatcctagtacgacacgtcgganccgagacggcgggctacggacaagggcgtaacg

SEQ ID NO: 101448 - DNA, 700 bp, Homo sapiens
  misc_feature: GYAE6OF01AP5K9.8.67.G01.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatccctccctgtctgcttctagtaggagacagacgtcaccatcacttgccgggacaagtcagacctattacgacttaaccttttttaaattggtaatcaaacagacgacccaagggaaaaccncccccaaactcctagtatttagtggtcacactcctagtttcgacgaaaggttcggggtcccatcgtaaggttcaggtggcaggtggatcgtgggcagtactttccaccctcaaccntacacgctacgtcctcgaccaaccgtaggaacgttaccgtttagacctaacctttacgtacgttacgtacaagtctagtacgttacgacgggttaccgggtccgggtaccttaccggtttcgggacccggaacggggtaacgaacggtcgtagggtacgaacgtacccggaaacgtaacgtcggtacggacttcggaacctacctacgttcgtcgttacctttacgtaccctttcccgtacccgtaccgtacgttaccgtacggaaccgtaccgaccgggtacggacggtcgaacgggtcgggtaccgggtacgtagggaacgtaacgggcgtaac

SEQ ID NO: 101449 - DNA, 586 bp, Homo sapiens
  misc_feature: GYAE6OF01EUEXP.8.67.G01.1.454.CMB.1.raw
tcagctcgcgtgtccacgaccggtgctcgattttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaaattggtatcaacagagcccaaggaaaacgccccccaaatcctgatttatggtgcatccatttcgcaaagtgggtcccatcaaggttcagtggcagtggatcgtggggcagtatttcaccctcaccatcagcagtctgcacctgaatactttgactaacttctactgtcagctagttcttacgagtacggcccggtactaccgtttcgggaccgaggggacgaagcgtgggacgtagtacgaacgtactggtacggctcgaccacctagttccgttgttcctttacctacgtttacccgttcccgaccttaacgttccgtagtacgaccacggacgacgccgtggaacgggtccgggtcgtacgggacgtaagggccgtacg

SEQ ID NO: 101450 - DNA, 573 bp, Homo sapiens
  misc_feature: GYAE6OF01DV3DD.8.67.G01.1.454.CMB.1.raw
  modified_base (176)..(176): a, c, t, g, unknown or other
  misc_feature (176)..(176): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (495)..(495): a, c, t, g, unknown or other
  misc_feature (495)..(495): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (561)..(561): a, c, t, g, unknown or other
  misc_feature (561)..(561): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctaactttttaaatggtatcaacagacgcccaaggaaaacgcccccaaatcctgatttagnggtncatccatttcgacaaaggtcgggtacccagtacgtaaggttcagtggctaggtggatcggtggggctagtacttccacctcacatcagcgagtcagaccaacgtagaacgtctttacgactaacttactactgtacagtctaacgttacgttacgaggtacgggccggtaccgtacgtttcgggaccgtaggggacgagcgtaggagacgtacgaacgagtggtacgcgtgacctactntctcgttctactacgttcctcccgctactcctaggacgaccacggcgngtcgnggcggtcggacgngacgaggcgacg

SEQ ID NO: 101451 - DNA, 639 bp, Homo sapiens
  misc_feature: GYAE6OF01CJGQ2.8.67.G01.1.454.CMB.1.raw
  modified_base (176)..(176): a, c, t, g, unknown or other
  misc_feature (176)..(176): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (620)..(620): a, c, t, g, unknown or other
  misc_feature (620)..(620): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattacgactaacctttttaaatggtaactacaacagacgacccgaaggaaaaccgcccccaaaactcctagtactttagnggtncactctatttcgacgtaaaggtcgggtaccagtacgaaggttcagtggacaggtggactcgtgggctagtactttccgacctcaactgtacacgcacgtctacgacaactagaactactttacgacctaacttacgtacgtgtacgacgctacgttactacgacggtaccggcccgggacttaccggttcgggaccggtaacggggacgtaagtcggtaggaacgtacgtacgaacgtacgtggacgtcgacgactaactacgttcgttcgtccttacaccgtttcccgtacccgctacttccgagaccgtaacgtccggacgtcggtcgtacggacgggtccggtacgnggaaccgagggcgtaacgg

SEQ ID NO: 101452 - DNA, 690 bp, Homo sapiens
  misc_feature: GYAE6OF01D98TM.8.67.G01.1.454.CMB.1.raw
  modified_base (431)..(431): a, c, t, g, unknown or other
  misc_feature (431)..(431): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaatggtatcaacagacgacccaagggaaaaccgaccccccaaactccctagtacttttagtcggtagcctatcctattttccgacgtaaaggtcggggtacccatacgtaaggttcagtggctaggtggagtcgtggggacaggtactttaccacccgttcaacctatcgagtacgacgtctacggactaacctagaacttacgtttcacctaaacttacctagtcgtnagctacgttacgttacgaggtacggccggtactaccgttcggacggtagggacgagacgtaggacgagtacggacgtacgttgtacggtctacggtacccaacgtccgttacgttcgttaccgtttaccgtacgtttaccccgttcccgtaaccgttacttaccggtacgtaaccggaaccgtaccgggtacgtacggttaccggtacgggtaccggggccggggttacggaccggggacggtaccggggcgtaaccgg

SEQ ID NO: 101453 - DNA, 696 bp, Homo sapiens
  misc_feature: GYAE6OF01BXLCC.8.67.G01.1.454.CMB.1.raw
  modified_base (293)..(293): a, c, t, g, unknown or other
  misc_feature (293)..(293): n is a, c, g, or t
  modified_base (667)..(667): a, c, t, g, unknown or other
  misc_feature (667)..(667): n is a, c, g, or t
  modified_base (692)..(692): a, c, t, g, unknown or other
  misc_feature (692)..(692): n is a, c, g, or t
tcagctcgcgtgtccacgaccggtgctcgatttagagtatacatattggggtttgggggcttttcctgggctcctgctactctggctccgaggtgccagatgtgacatccagatgacccagtctcactcctccctgtctgcttactagtaggagacagtacgtcaccatacgacgttcggccgggacaagtcgaagtaccattagaccttaaacttttttaaagtcggtaataccaaacgaggaaccgtaccgaaaggaaaaccgtccccaaaactccgtagtaacttttagnggtacactacttccgtagtttacgaacgtaaacgggtccgggtaccatacgtaagttcgaggtcgagtagtcggacttcggaggggctaaggtactttacccacccttacactaacacgagacgtagtctacgaaccaaacggttaggaattaccgttaaacccgttaaacttaaccttagtccggtaacaagtaccgtaatttccggaagtaccgggtacgggaccggtacgttaccgggtacggtaacggaacggggtaacaacggtccgtaggacgtaacggaacgtaacgtaacgtggtacggcactaccgactagtcgtacgtactccttacgtaccctcgtaccatcgtacgacgtacaggacggtcncggtagcggtcggtacgagacggancgga

SEQ ID NO: 101454 - DNA, 1003 bp, Homo sapiens
  misc_feature: GYAE6OF01DOF26.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgccaaggaaaacgcccccaaatccctagtattttagtggtgcattccctattttaccggacgtaaaaggttcgggggtaccccctaagttccgtaaagggtttccaaggttcgggaccgtaaggttggggaaacttccgggttggggggtacctaaggtaacctttttacccgaaccccctttaccaaacccgtaattacccgaagaccctaacgggttaccttacggaaccctaaaaccccgtttagggaaaacgttacccgtttttaaggaaccctttaaaaccgttttaacccttaaaccgttccggtttaaccgaaaccgggttaccttaaacggtttaacccgttttaaaccgggtaacgggttttaaaccgggggaccccccgggggtttaccctttaaaccccggggttttttcgggggaaacccccggggttaaacgggggggtaaacccggaaaaacgggtcccggtttaaggggggaaacggttaaaccggttaaacccgggtaaaaacccgggttaaaccggtttcggggttaccggggttacccgttaacggaacccccgtaacccgttaacggttttccccgtttacggggtttacccttttaccgtaaccgttttcccccgttaccccggtacccttaacggttaccccttaggggaaacccgtaaacccgggtacccggaaccgggtacccggttaccggtaacggggtaacccggggtcccggggtacggttagggggaaaccccgtaaacgggggtcccgtaaaccgg

SEQ ID NO: 101455 - DNA, 848 bp, Homo sapiens
  misc_feature: GYAE6OF01B3I4H.8.67.G01.1.454.CMB.1.raw
  modified_base (149)..(149): a, c, t, g, unknown or other
  misc_feature (149)..(149): n is a, c, g, or t
  modified_base (838)..(838): a, c, t, g, unknown or other
  misc_feature (838)..(838): n is a, c, g, or t
tcagctcgcgtgtccacgaccggtgctcgatttagagtatacatattggggtttgggggcttttcctgggctcctgctactctggctccgaggtgccagatgtgacatccagatcgacccagtctccattcctccctgtctgcttctanaggagacagagtcaccatcacgttggccgggactaaggcaacgacctaagttacgacctttaactttttaaagtcggtaactacgaaacaggaacgacccaaaacgggaaaacccaccccctaaaacttccgtagttaacgtttttagcgggttcaacctagttaccttaacgtttaccggaacggtaaaacggttccggggtaaccctagttaacgtaaacggttacgagggtcggacgtagggttacggtacgtcggtacggggtactaacggtaccttttacccacccttacccgaaacctacgtaccgaacgtaccgtaccgttacgtaccggaaccttaaaccggtagtaaaccgttagttaccgtaacctaaacctttacctacgttacgtaccgtagtaccgtacgttacgttacgggtacggtaccgggtaccggtaccggtttaacggttccggggaacggaacggggaacgtacggacggtagggaaaccgtaggtaacccggtaacgttaacggtcggttaacggtccgtagacccgtaacgtttaaccgtcggtttaaccttccgtttaccgtaccctttaccccgtaccccggtactaaacccggtttcgaaccgggtaacgtacccgtacgggtaacgcgacggttacggaccggttcgggacggtacgacgggngtaccgtaag

SEQ ID NO: 101456 - DNA, 786 bp, Homo sapiens
  misc_feature: GYAE6OF01E0I62.8.67.G01.1.454.CMB.1.raw
  modified_base (153)..(153): a, c, t, g, unknown or other
  misc_feature (153)..(153): n is a, c, g, or t
  modified_base (182)..(182): a, c, t, g, unknown or other
  misc_feature (182)..(182): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatccctccctgtctgtcttctatagganacagagtcaccatcacttgccggcaagtnagaccattagctaaccttttaaatggtatcaacagacgaccgaaggaaacgacccccaaatcctagtactttagtgtcgactactcctacgtttacgacgtaaacggttcgggtaccctaagtacgtaaggttcaaggtcggacgtaggtggtaacgttcggtagggggtacaacggttactttacccgaccccgtaacgacctaagtccgtacgtaccgtagttccgtacgtacccgtaaaccgttaggtaaacgtttaccggtttaactaaccgttaaaacccgttttaccgtaaccgttacggtaccaacggttacctaacggtttaacccttaagggtacgggtaacccggggtaccccggtaccgttaccgggtttaaccgggacccgggtaaacggggtaacgtaaaggtccggtaagggtaacgtaacggtaacgtaaaccgggtacgttgggtaccgacgttaccgactaccgtacttaccggttcttacctttacttacccgttccgtacccctacgttacgaccgtacgaacggaccctacggaccggtgtaccggtaggccgggacggtacgtaaccggacgtacggcgtacg

SEQ ID NO: 101457 - DNA, 705 bp, Homo sapiens
  misc_feature: GYAE6OF01CPW7F.8.67.G01.1.454.CMB.1.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (683)..(683): a, c, t, g, unknown or other
  misc_feature (683)..(683): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttcataggagacagagtcaccatcacttgccgggcaagtcagaccattagctaccttttaaatggtatcaacagagcccaagaaacgccccaaactccngtatttangtgcatcatttcgcaaaggtcgggtccatcgaagtcagtggcagtgatcgtggggctagatttccacctcacctactacaggtacacgtcgtagtaacctaacctagaaacgtaccgttttcggaacctaaactttaccgtacgttacgttacgacgacgtagtaccttaacgtacggttaaccgggccgggtaccgttaaccgttttacgggaccccgttaagggggggaacgtaaacgggtaccggttagggtaacggactaacggggtaaacgtaacggtacgggttacgggtaccgttaggccctaacccgtaagtttcccgttagggttacctttacctaaccgtttcccgttaaccccggccttaaccgtccgtttagaaccggttacgaccgggttaccgacggtacgttacgacgggcccgggtacgngggtaaccgagggtcgtaacgg

SEQ ID NO: 101458 - DNA, 748 bp, Homo sapiens
  misc_feature: GYAE6OF01CBYNI.8.67.G01.1.454.CMB.1.raw
  modified_base (267)..(267): a, c, t, g, unknown or other
  misc_feature (267)..(267): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccattcctccctgtctgcttctataggagacagagtcaccatcacttgccgggacaagtcagaccattacgacttaacctttttaaatggtatacaacagacgaccgaaggaaaccgaccccaaactcctagtatttagtggtnactatacctagtttcgacgtaaaggtcgggtacccatacgaaggttcagtcggcaggtgtagtcggtgggactagttacttcccacctcgaacctagtacacgtacgtacgtcacgaacctaacgtagtaacgttacttagaaccttaacttaacctagtacgttacgacgtcgtaagttcctttaacggacggtaccggggtacccggtaccttaccggtttacgggacccggtaacgggggtaacggtaaggtacggtacggaagttaaaccgtaaccgggaaacgttaccgggtagggttaaccggcctacggtaccctaaaccgtttacgtacccgtttagttacccgtttaaccgtacccgtttaccccgtacccgttacctaacggttactaacccgggcgtaaacccgacggtaccgtacggtcgtaaaccgggcgggttccggggaccgttgggaacccgtagggccgtaacg

SEQ ID NO: 101459 - DNA, 781 bp, Homo sapiens
  misc_feature: GYAE6OF01BH6GL.8.67.G01.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
tcagctcgcgtgtccacgaccggtgctcgatttagagtatacatattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggganagagccaccctctcctgtgccggccagtcagngcgttaggactaacttgcctggtancgagcagacggcctggccacggcctcccagacctcctctacttcctttcgggcctaccttttaaacgacggggtcccaaggttcgggaaaccttcccccgaaggacccgagggtttacccacgggtccgggaccgtagggtcggggttccgttcgggggtaacccgtttcggtttacctaccgtaccttcccaaccctaataccgtaaaaccttaacccgtgaacctaagttccgtaacgtaccgggttaaccttttcgacctttaaggtttttactttaccttacggtaccagtaccctaggttactacggtaaacggtccgtacgggttcccgtttacgttacccggtttaccggggaccggggtaacggggtaacccgtaaggggtacccggtaacccgtaaccggtaaaccggtaacttggggtaacggcccgttacggacccctaaccgtgttaccccgtttggtaccttttaccacccgtttaccccgttaccccgtcccgtaacgttaccggg

SEQ ID NO: 101460 - DNA, 857 bp, Homo sapiens
  misc_feature: GYAE6OF01CN5ME.8.67.G01.1.454.CMB.1.raw
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (185)..(185): a, c, t, g, unknown or other
  misc_feature (185)..(185): n is a, c, g, or t
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (510)..(510): a, c, t, g, unknown or other
  misc_feature (510)..(510): n is a, c, g, or t
  modified_base (627)..(627): a, c, t, g, unknown or other
  misc_feature (627)..(627): n is a, c, g, or t
tcagctcgcgtgtccacgaccggtgctcgatttagagtatacatattgggtttgggggctttcctgggctcctgctacgtctggctccgaggtgccagatgtgacatccagatcgaccctagtctccatcctccctgtctgcttntagagganacagacgtcacctatcgtacttcggccggganaaggttccagtaacctattacgtacctttaaaccgtttttaagtcggtactacaacgacggaacacccgaaaggtaaaaccncccctaaatcctagttaactttaggacggtanacctacttaccttagtttacggaacgtaaagggttcgggtaaccctaagttacggtaggttacgtcggtaggacgtaggtacggtacgttcggtacggggacttacggttaccttaccgaaccctacctaacccgtagtaccgacgtacggtaacgtcgtacgacgtaaccgtaagggtactacgttacgtaaccttaacttacgtacgtntacgagtaccttacggtagtaccgtaaggggtcccgtcggtaaccgttaccggttacgggaacggtacggggaactacggaggaacgtacggaacgtaacgggactaacggtttcgnggacctttaccggaccttaacggtcggtttaaccttaccgtttacccgtaccgtttacccgtaccccggtttaaccccgaagtttccccgggttaacgacccggggaaacccttccggggaaaccccgggttacgggtaaaccggtccccggggttaaggggaacccccggggttttcccggggaaaccggtaacccggggaaacccgggggaggtaccccgttaagggg

SEQ ID NO: 101461 - DNA, 793 bp, Homo sapiens
  misc_feature: GYAE6OF01CF1V3.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggatacagagtcaccatcacttgccgggacaagtcagacctattacgactactttttaaatggtatacaacagacgacccgaaggaaaaccgaccccctaaaactcctagtaacttttagtggtcgacactcctagttttccgacgtaaaggtcggggtacccaagttaccgtaaggttccaggtcgggctaaggtggagttccggtagggggactaggtacgtttcccaccccgtacaacctacgtacacgccgtacgttcgtacgtacctaaccgtagtaaacgttccgtttagaaccctaaaccgtttactacgttacgtacgaggtaccgtagtttccgttaacgacggttaccgggcccggtaccgttacccggtttcgggacccggtaaacggggacgtaacgtccggtaagggaacgtaacggtacccggaaacgtaacggttcggtacgggtacccgtacgtaacccgtaaccgttacttacccgtttcggtttacctttaccgttacccgttacccccgtttaccccgtaccgttaccgtaccgttacggaaccggtaacccggtacgggaccggtacgtaccgtagggtacccgggtacggggtaccgtacggggaacggacgggtccggtaaacg

SEQ ID NO: 101462 - DNA, 650 bp, Homo sapiens
  misc_feature: GYAE6OF01A392O.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatacaacagacgacccaaggaaaacgcccccaaaactccttagtatttagtggtgcatccatttcgactaaaggtcgggtcccagtacgaaggttcaggtggctaggtggatcggtagggcagtatttccaccctcaccatacagctagtctgacaactgaacgtctttgactaactttacacttgtcgatacgtagttactaacgaggttaccgggcccggaccttaccggtttcggacccgggtaaggggaacgtacggtaccgtagggaactaggtaaccgaacggtacgtgggtacggacctacggaccctaacctagtttcgtacgtttacccttagtacccttaccccgttcccgaccgtacttacggtaccggaacgtacccggacgtcggacgtcgtagggcccgtcgggtacgtaggacgtaacggcgtacg

SEQ ID NO: 101463 - DNA, 815 bp, Homo sapiens
  misc_feature: GYAE6OF01CNFC8.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatcgacccagtctccactcctccctgtctgtcttactagtaggagacagacgtacaccatcacgttcggccgggacaacgtcacgtacctattacgtccttaaccgtttttaaagttggtactaccaaacgacggaccgacccgaaaggaaacccaccccctaaactccgtagttacgtttaggtcggtacactactccgtactttcggacgtaagggtccggtaccctagtacgtaacggttctaggtcggacgtaggtggtacgtcggtacgggactacgttaccttaccgaccctacacctagtaccgcgacgtacgtccgtacgtaccgtaacgtacgtaacgtttcgttacgtaacttaaccgttacgtacctagttaccacgtacttaccgtacgttaacggacggttaccccgggcggttaccgttacggtaccggggaccggtaaagggccgaaagggtcgttaaacggacgttacgtaaccgggaaccgtttggtcggttaccggaccttaacggaccgttaccgttagtacccgtttacgttccctttaacctaccccgggttcccgtaccggtacccttacggtaccggtaccgttaaccggaccggtaccgggacggttaacccgtcgggggttaccaacccggggggtttccgacgggaccgggttaaaccgcggggtttaaccaaccggg

SEQ ID NO: 101464 - DNA, 703 bp, Homo sapiens
  misc_feature: GYAE6OF01B9PO1.8.67.G01.1.454.CMB.1.raw
  modified_base (615)..(615): a, c, t, g, unknown or other
  misc_feature (615)..(615): n is a, c, g, or t
  modified_base (621)..(621): a, c, t, g, unknown or other
  misc_feature (621)..(621): n is a, c, g, or t
  modified_base (636)..(636): a, c, t, g, unknown or other
  misc_feature (636)..(636): n is a, c, g, or t
  modified_base (662)..(662): a, c, t, g, unknown or other
  misc_feature (662)..(662): n is a, c, g, or t
  modified_base (698)..(698): a, c, t, g, unknown or other
  misc_feature (698)..(698): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctagtaggagacagagtcaccatcacttggccgggacaagtcacgacctattacgacttaacctttttaaatggtactacaaacgagacgacccgaaaggaaaccgaccccctaaactcctagtatttagtggtgactacgttacctagttccgacgtaaacgggttcgggtaccctagtacgtaacggttcaggtacggacgtagggtggtacgtcgggtaggggactaacggttacctttacccgaaccctcaacctagtcgtacgctaacgtcttacgaactaaccgtaggtaaacggttacctttaggaacccttaaacgtttactaccgtagtacgaccgtacgttaacgttaccgtaacggacggtaccgggcccgggtaccgttaccggtttcgggaaccggtacggggaacgaacggacggtagacgtaacgtacggaaacgtagtcgtggtcgcgactaacgtntccgtnttactctaccgtccnccgtactcgtgtacgacggtcacggngacgtcggaggcgggtacggacgtacggcgtacggntacgg

SEQ ID NO: 101465 - DNA, 811 bp, Homo sapiens
  misc_feature: GYAE6OF01CLLQB.8.67.G01.1.454.CMB.1.raw
  modified_base (395)..(395): a, c, t, g, unknown or other
  misc_feature (395)..(395): n is a, c, g, or t
  modified_base (475)..(475): a, c, t, g, unknown or other
  misc_feature (475)..(475): n is a, c, g, or t
  modified_base (575)..(575): a, c, t, g, unknown or other
  misc_feature (575)..(575): n is a, c, g, or t
tcagctcgcgtgtccacgaccggtgctcgatttagagtatacatattgggtttgggggcttttcctgggctcctgctactctggctccgaggtgccagatgtgacatccagatcgacccagtcctccactcctcctgtctgtcttactagtaggagacaggtactaccaccatctacgtcggaccgggacaagcacgactattacgacttaacttttaagtgtatacaacgagacaccgaaggtaaaccgaccctaaacgtctagtattagtggctactaactcttaacgttacggacgtaagggtccggtaacctagtaggtaacgttcgaggtcggacgtaggtcggtactcgggtagggactaacgttacctttacccgaccctactaaccncgttaccgaagtcgtaccgttcgtaccgacgtaaactaacggggttaacttaaccctttacgaacccgttaaactttaanaccgtttagaccgtaaagtcctaaagtttccgtaaccggtaacgggtccgggtaccggtacgttaaccgggtgggaaccggaaggggtactaaaccgggngttacggggaataacgtaaccgtaaggtcgacgggttacgacgtactaacccgggtaactttacggtctttaccgttaccgtttaccgtacccttacccggttaaccccgtacttacccgggttacgtacggaaacccggttaccgggacccgggttaacgtcggtaccgggtaaccgggtccggggtacccgggttaacggtaaccggggaacggtaccgggtaccgggtaaacg

SEQ ID NO: 101466 - DNA, 582 bp, Homo sapiens
  misc_feature: GYAE6OF01A658U.8.67.G01.1.454.CMB.1.raw
  modified_base (211)..(211): a, c, t, g, unknown or other
  misc_feature (211)..(211): n is a, c, g, or t
  modified_base (535)..(535): a, c, t, g, unknown or other
  misc_feature (535)..(535): n is a, c, g, or t
  modified_base (576)..(576): a, c, t, g, unknown or other
  misc_feature (576)..(576): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagaaagagtcaccatcacttgccgggcaagtcagaccattagctacttttaatggtatcaangagccaaggaaacgcccccaaactcctgtatttagtggtgacatcctatttcgactaaacggtggggtacccatacgaaggtttcagtgggcaggtggatcgtggggcagtactttccaccctcaccatcagcagtctagccaaccgtgaacgtactttgactaacgttactctcgtcagctagtcttacaggtacggccggtctaccgttggaccgtaggggacgagcgtaggagagtacggaacgtacgtggtgactggaccactattcgtgtaccttctacttcccgtccccgtacagttacctgacgtaccgaaccggtnaacggccgtaggtacggcggggtacgtcggagacggaccgngtaacg

SEQ ID NO: 101467 - DNA, 669 bp, Homo sapiens
  misc_feature: GYAE6OF01BK40S.8.67.G01.1.454.CMB.1.raw
  modified_base (176)..(176): a, c, t, g, unknown or other
  misc_feature (176)..(176): n is a, c, g, or t
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
  modified_base (425)..(425): a, c, t, g, unknown or other
  misc_feature (425)..(425): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctactttttaaatggtatcaacagacgacccaaggaaacctcccccaaatccttagtatttagtggtnactactccatttcgactaaaggtcgggtaccaatcgaaggttcagtcggctaggtggattcgtaggggctaagtactttaccgacccttacaccctntacgacgtctacgtctacgacctaaccgtagaacttaccgtttgaacctaacgtttactactgtacganacgtacttacgttacgaggtcggtccgggacttaccggttcggacggagggaccgtaggtccgttgggaacgtactacggaaccgtacgttaggtacgtcgtacgccgtaaccgttgtaccgtttcgttaccttacccgttcgtaccccttaccgaccttactaccgttaggacccgtaaccggtcgacggtaccgtccggtagggtccgtacggggtccgtaaggcgtaaccggtcgtaaccg

SEQ ID NO: 101468 - DNA, 767 bp, Homo sapiens
  misc_feature: GYAE6OF01BVTAL.8.67.G01.1.454.CMB.1.raw
  modified_base (150)..(150): a, c, t, g, unknown or other
  misc_feature (150)..(150): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (341)..(341): a, c, t, g, unknown or other
  misc_feature (341)..(341): n is a, c, g, or t
tcagctcgcgtgtccacgaccggtgctcgatttagagtatacatattgggtttgggggcttttcctgggctcctgctactctggctccgaggtgccagatgtgacatccagatgacccagtctcatcctcctgtctgcttctagtagganacagagtccacctatcacttcggccggacaagtcagacctattacgacctttaacctttttaaagtggtactaccaacagacgacccgaaggaaaaccgaccccctaaatcctagtatttagnggtnctatcctacgttacgactaaggtcggtaccctagtaacgtagtcaggtcggacgtaggtacggngtccggtagggacctaggttacctttacccgaaccccttacgaaccctacgttacaacggtaccgtacggttcgtaccgaaacctaacgtacgtaaacgttccgtttaacgaccgtttaaacgtttaccgacgtttcggaactaccggtacgttaacttaccgttaacggtacgggtacccgggttcccggtaccgttaccggtttccggggaacggtaacggggtaacgtacgtaggtacgggaactacggttaaacgtaccggtaacgtgggtaccggtactcggtaacctaccgtacgtttcttacgttccttaccggtaccttccgtccccggaacttcgtacggtaccgagtacccggcgtacggtaccgtcggaacggtcggggtaccggtaatacccggggacgtaacggtccgtaaag

SEQ ID NO: 101469 - DNA, 762 bp, Homo sapiens
  misc_feature: GYAE6OF01B5QA2.8.67.G01.1.454.CMB.1.raw
  modified_base (99)..(99): a, c, t, g, unknown or other
  misc_feature (99)..(99): n is a, c, g, or t
  modified_base (658)..(658): a, c, t, g, unknown or other
  misc_feature (658)..(658): n is a, c, g, or t
  modified_base (687)..(687): a, c, t, g, unknown or other
  misc_feature (687)..(687): n is a, c, g, or t
tcagctcgcgtgtccacgaccggtgctcgatttagagtatacatagttgggtttgggggctttccgtgggctcctgctacgtctggctccgaggtgccngatgtgacatccgagatgacccagtactcactcctccctgtcgtgcttctagaaggcgtactgagtcacctaagttacacgttgccgggctaagtcagacctagttagcgtaaccgttttaaagttcgggattcaaacgaggaccggtcccgtaaaggaaaacgacccccctaaatcgtagtaattttgaggtgactatacctatttcgaacgtaaacgttcggggtacccagttaccgtaacggttaccgaacgtggtaccggtaggtttaccggaacttaccggttcggggactacggttaaacgtttccccgtacctacggaccctaagttcgaacgtaccgtagtaaccttcggtaacaaacccgttagggtaaaattacccgtttaagtaacttaaccgttaacctaccgttaggttaactcggaagtttacgaaccgtttacgaacgggtacggtacccggtaccgttacgttaccggaccgaagggttaaccgaaggtaccgagggtaagtaaccgaacgtaaacgtccgtagacgtacgcgacaacgtacncgtactaccgtagctaccggttcaccgtntaccgtaggtacgtaaccgacgtagaccgtaccggtaggacctacggggtatacggtacgaaagggtctaaacgg

SEQ ID NO: 101470 - DNA, 744 bp, Homo sapiens
  misc_feature: GYAE6OF01AEV1M.8.67.G01.1.454.CMB.1.raw
  modified_base (425)..(425): a, c, t, g, unknown or other
  misc_feature (425)..(425): n is a, c, g, or t
tcagctcgcgtgtccacgaccggtgctcgatttagagtatacatattgggtttgggggcttttcctgggctcctgctactctggctccgaggtgccagatgtgacatccagatcgacccagtctccactcctcctgtctgcttcgtagtaggagaccagagtccaacctatcctacgttcgggccgggactaacgtacgacgtacctagttacgtacctttaaacctttttaaagttggtaactaccgaaacgacgaacccgacccgaaaacgggaaaaccctaccccctaaaacgtccgttagttagtttagtggtacacgtacttacccttagttaccgaacgtaacgggtccggtaccctaagtacgtaacgtgagtggactaggtcgtagtcggaggactacgtcttacccacctcaactncagccgtagtctacgacctaacgtagtataccttacgaaccttacgtactacggtgtacaacgtcgtacgttaccgtaacggacggtacccggtccggttaacgtaccggttaccgggaacccgggtaacgggaccggtaaaggtccgtaagggtaccgtaaacgggtaccgtaaacggtcggtacgtccggtaacctcgtaactacccgttgtccggttacgtcccgttgtaacccttccggtaaccccgtactaccgtaccgtaaacgccgtacggcgtcacgggtcgaccggtacgacgaggtccaacgtccgagg

SEQ ID NO: 101471 - DNA, 695 bp, Homo sapiens
  misc_feature: GYAE6OF01AV41L.8.67.G01.1.454.CMB.1.raw
  modified_base (197)..(197): a, c, t, g, unknown or other
  misc_feature (197)..(197): n is a, c, g, or t
  modified_base (325)..(325): a, c, t, g, unknown or other
  misc_feature (325)..(325): n is a, c, g, or t
tcagctcgcgtgtccacgaccggtgctcgatttagagtatacatattgggtttggggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagcccaccctctcctgtcggcggccagtcagagcgttaggacgaacttaggcctggtactcgagcgagacggcctggccaggcctcccagcctcctcattcgtttggcctcctttaacgngggcctaggtcgaactccccagccgtaggttccaggcggactaggtcgggtcgtggggtaccttcggtttccaccgttctaccgaaccctaagtaaccctaaattaacccgtgtacctaatcgttacgaccgtacttttggacttagttttacttcgtacggtctaggtctagtcgtagtaacgtcctacgggttccgttacgttaccggtttccggggacgggtaacgggtaacccggtaaggttccggaacccttaaccggaaaacggtacccgttagggtacggtaccgtaccggtacctaacccgtagttcccggttagttccctttaccggtaccctttacccgttccccgacccttacgtaccg

SEQ ID NO: 101472 - DNA, 939 bp, Homo sapiens
  misc_feature: GYAE6OF01AOZXH.8.67.G01.1.454.CMB.1.raw
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagcttaacctttttaaatggtatacaanagacgcccaagggaaaaccncccccaaaactcctagtaattttagtgggtcgactacgtcctagttttccggacgtaaaagggttccgggggtacccctaagttaccgtaaagggtttccgaaggttcgggactagggttagggtaacgttccgggttagggggggacctaacgggttaacctttttaccccgaacccccgtttaccaaaccccgtagttaccgaacggtaccgtaacggttcctaccgggtaaccctaaaccgttacgggtaaacgttacccgttttaacggaaaccctttaaaaccgttttaaccttaaccggttacggttacccgaacggttacccgttaaacgggttttacccgttaaccgggtaacggggttaccgggggtaccccggggttaccgttttaaccccggggttttacgggggaacccccgggtaaacgggggggtaaaccggtaaaccgggtacgggttaacggggtaaacggttaaaccggttaaccgggtaaaccggtaacggtttcgggtaacggggtccgtaaccgggtaacccttaacccggttaccgtttaccggtttaccggtttaccctttaaccgttaacccggtttccccgttaccccgaccgtttaccgtaccgtacggaacccgtaccggaccgtacggcgtccgtacggacggtccgggtacggacggaccgtacggtccgtacg

SEQ ID NO: 101473 - DNA, 845 bp, Homo sapiens
  misc_feature: GYAE6OF01C62GW.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatcgacccagtctccatcctccctgtctgcttctagtaggacgacagagtacacctatctacgttcggaccgggactaacgtcgacgtaccctatttacgtaccttaaccttttttaaagttggtaacttaccgaaacgacggaaccgacccgaaaacgggaaaaccacccccctaaaacgttcctagttaattttacggtggttacaccattacccttacgtttacggactaaagggttccggggtacccctaagttaccggttaagggttcctaaggtcggacgtaggttagggacgttccgggttcgggggactaaggttacctttcccaaccctaccgaacctataacgcgtacgtaacgtcgttacggaacctaaccggttagtaaacgtttaccgtttacgaaaccctttaaccttacgttaaccggtcggttacacggtaacttacgtaacgttacggaacggttacccgggaccggtttaccgttaccgggtacgggaaccggaggtaacggtacgtggtacgaagtaaccggtacgaaacgttacggtcggtacgtaccggacgtaccttaccgtacgttaccgtttccgtttaactaccggtttcccttcccgaaccgttccgttacgtaccggtacggaaccgtaaccggacccgtggtaacccggtcggttaacgggccgggtaccgggttacggaacgggaaccgggccggtttcgaaagg

SEQ ID NO: 101474 - DNA, 861 bp, Homo sapiens
  misc_feature: GYAE6OF01AWIZU.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatcgacccagtctccactccctcctgtctgtcttctagtaggagacagacgtcacctactacgtaccgttcggcccgggactaacggtcgaacggtacctaagttacgtacctttaacctttttaagttcgtactacaacgacgacgacccgtaacggaaaccgaccccctaactccgtgttaacgtttagtcggtcgactactaccgttagttaccgaacgtaacggtccgggtacctacgtacgtaacggttcgtaggtcggacgtaggtcggtacgttcggacggggtctacgttaccttacccgtacctaccgacctacgtaccgtcgtactaccggtacctacgtaaccgtacgtacggtaaacgttaccgttaacgtaacccttaaccggttaaccttaccgtaacgtccgtaaccggtacgttaaccggttaccttaacggggtaccgggttaccgggtacccgggttacccttaccgggggttacgacccggggtaacgggaaccgttcggtaaccggttacgggtaacggtaaaccggtaccggttaaccgggtaccgtacggggttccgtacccgtagtaaccccgtaccgttcggttaccgttacctttccgttacccgttacccgttaccgtaccccggtacttaccggtaccgtaccggaccgtacccggtaggtacccggtacgttacggacggttcccgggacgggtccgtaaccgggtacgtccgacggttacg

SEQ ID NO: 101475 - DNA, 864 bp, Homo sapiens
  misc_feature: GYAE6OF01AZSEY.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctcatcctccctgtctgctttctataggagacagagtcaccatcacttggccgggcaagtcacgaccattacgtacttaacttttttaaaatggtactacaaacacggacgtacccgaaagggaaaaccgacccccaaaacgttcctaggttaatttttaacgtcggggtagacctaacgttcctagttttaccggaacgtaaaacgggttccgggggtaccctaacttacgaaacgggttcaacgggttgggaccgtaggtagggtacgttcgggtagggggaccttaacggtactttcccaacccttaccacgacttcgaacgtactaacggtccttacggaacccgtaactaacgggtaaacgttaccggtttacgtaacctaacctttaacgttaccgttacgtacggtactacgttacggttaccttaacgggtacgggtaccggggtcccggttaaccgttaccgggtttacgggacccggggtaacggggtaacggaacgtaccgggtagggaacgtaacggtaaccgtaaggtacgttcgggtccgtagtcggaaccctacgttaccgttagtcccggttactttacccgtacccttacccggtttcccgaccgtttaacgttcccggtaaacggttaccggaaccgaccggggttaacgtccggtaaccggggttagacccgggggtaccgggacgggtttaacccggaacgggttaacggccgggtaaaacgg

SEQ ID NO: 101476 - DNA, 724 bp, Homo sapiens
  misc_feature: GYAE6OF01CAN2Z.8.67.G01.1.454.CMB.1.raw
  modified_base (272)..(272): a, c, t, g, unknown or other
  misc_feature (272)..(272): n is a, c, g, or t
  modified_base (680)..(680): a, c, t, g, unknown or other
  misc_feature (680)..(680): n is a, c, g, or t
tcagctcgcgtgtccacgaccggtgctcgatttagagtatacatattgggtttgggggcttttcctgggctcctgctactctggctccgaggtgccagatgtgacatccagatcgacccagtctccatcctccctgtctgtcttctataggagacagacgtcaccatcacgttggccgggtacaagtccagacctattagaccttacctttttaaatggtatacaacagacgacccaaggaaaaccgccccctaaactcctagtatttacgnggtcacactacctacgttcggaacgtaaacgggttcgggtaccctaatacgtaaggttcaggtggactaggtacggacttcgggtcggggactaacggttacctttacccaacccttaccgaacctcgtaacgcggtacctaggttctaccggacctaaacggtataacgttaccgtttacgaaccttaaccgtttctaacgtgtacgaagtctacgttacgtacgtacggtaccgggtccggtaccttaccggttacggggacggtaacgggaacgtggtacggtcggtaatccggtaaccgtaacgcgttcgtcggactttccggaaacccttcgtagttccgtttacgttaccttaccgttacgtccccttaccccggacttcgtaccgagtaccgacgtaccgngtacgcgggaggaccgggtcggacggtcgggaacgcgggtcagg

SEQ ID NO: 101477 - DNA, 750 bp, Homo sapiens
  misc_feature: GYAE6OF01BOU4B.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcacatcacttggccggcagtcagaccattacgcttaactttttaagtggtactacaacagacgacccgaaggaaaaccgacccctaaacgttccgtagtacttttacgtggtcgactactacctagtttaccgacgtaaacggtcggggtaccctagttacgtaaggtttacgaaggttcggagtaggtacggtacgtcggttagggggactacggttaccttttacccgaaccctactaaccctaacgttacgacgtaccgtacgttacgtcgaaccgtaaaccgtagtaacgttaacgtttacgaaccttaaactttacgtacgtacgtacaacgtctacgttacgttacggaggttaccggacccggtacgttacccggttacgggacggtaacggggtaacgacggtacggtaacgggtacgtacggtaaccgggaacgttaggtacgggttacgacgggttacgacccgtaacgtactttccgttacggtttaccttcgtacccgttccgttacccgacgtcgttacgtacggacgtaacgcggcggtacgaggtggaccggtcgggacacggggactcggtcaacg

SEQ ID NO: 101478 - DNA, 757 bp, Homo sapiens
  misc_feature: GYAE6OF01AYQ3E.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatccttccctgtctgcttctataggagacagacgtcaccatcacttggccgggcaagtcagaccagttacgacttaacctttttaaacgttggtatactaacagacgacccgaaggaaacgacccccaaactccgtagtactttagtggtacgactactacctacgttacgacgtaaaggtcggggtacccagtacgtaacggttcgaggtcggcgtaggtggtactcggtgggacgtaggtactttacccgaccctacaccatcgacgcgtaacgtcctacgacctaaccgtacggtaacgttacctttacggaccttaaactttaaccgtacgtccggtacgacgtacgtacgttaccgtttaacgtaacgggtaccggggtacccggtaccgtttacccgggtttaccgggaccgggtaacgggggtaaccgtacgggtaccgttaacggggaacggtaacgtaaccggaacggtaacgtcgggtacggacgtacgaccgtacgtacgttcgttcgttccttacgttaccgttcccgttaccccacgttactcggtacgacgtaccgaccggtacggacgtacggtcggacgggtccggggaggttacgggacgacggggtcgtaacgg

SEQ ID NO: 101479 - DNA, 814 bp, Homo sapiens
  misc_feature: GYAE6OF01BV3ZO.8.67.G01.1.454.CMB.1.raw
  modified_base (390)..(390): a, c, t, g, unknown or other
  misc_feature (390)..(390): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccactcctccctgtctgcttctataggacgacaggagtcaccatcacttgccggcaagtcagaccattagcttactttttaaatcggtatacaacagacgacccaaaggaaaaccgcccccaaactccgttagtacttttagtaggtgactacttctatttacgacgtaaagggtcgggtaccccattaccgtaaggttcaggtggacagggttacggattccgggtggggactacggtactttacccgacctacacctatacgacncgaggtcctcggaacctaacgtacgtaaacgtactttacgaacctaaactttacgagttacggtactacgacgttacgttacccgttaagtaacgggtcccgggtaacccggtaccgttaaccccggtttaacggggacccgggtaacgggggtaaacgtaacggccggtttaagggaacgtaacggtaacccggtaaacgtaacgggttcggtacggtcccgtaacggaccctaacgtaagttccctttaacgggtttcctttaacccggtacttccccggtttaaccccctagttaacccgttggtaaacgttaacccgggaaacgtaccccgggtccggtaaacggcccgtttaaagggggcccggggttaccggggtaacggttaaccgggggaaccgttaaaggggacccggtaaaccg

SEQ ID NO: 101480 - DNA, 746 bp, Homo sapiens
  misc_feature: GYAE6OF01DFXNR.8.67.G01.1.454.CMB.1.raw
  modified_base (128)..(128): a, c, t, g, unknown or other
  misc_feature (128)..(128): n is a, c, g, or t
  modified_base (131)..(131): a, c, t, g, unknown or other
  misc_feature (131)..(131): n is a, c, g, or t
  modified_base (518)..(518): a, c, t, g, unknown or other
  misc_feature (518)..(518): n is a, c, g, or t
  modified_base (736)..(736): a, c, t, g, unknown or other
  misc_feature (736)..(736): n is a, c, g, or t
tcagctcgcgtgtccacgaccggtgctcgatttagagtatacatattggggtttgggggcttttcctgggctcctgctactctggctccgaggtgccagatgtgacatccagactcgaccccagtccnccnctcctccctgtctgctttactagtaggagacaggtactacaacctataccacgttcggaccgggacaaggtacacgtacctattacgtacctttaaccgtttttaaagtcggtactacaacgacggaccggaacccgaaacggaaaacccgtacccccctaaaacgtccttaaggttagttttaggtggtctaccacttaccgtagtttacgacgtaaagggttccggtaaccctagtacgtaaggtctaggtcgacgtaggtgtaacgtcgggtacggactacggttacttacccacccttacaccgtactcgacgtctacggttccaggtaccaacggtaactaacgtactttacgaaccttaacgttaacgtcgtacgttacgntacgtacttacggttacgacggtaccggtacgtaccgtacggtcggacgggtacgggactacggtaggtacgacgtacggtaaccgaagtccgtagccgactcggactacgtcttcgttacgttctaccgttacttcccgtactacgttaccgtgacggtacgaaccgtccgggaacgtccggaacgtccgggaacgcggggacgtccgggtaacggngggtacacgg

SEQ ID NO: 101481 - DNA, 878 bp, Homo sapiens
  misc_feature: GYAE6OF01CJ1OA.8.67.G01.1.454.CMB.1.raw
  modified_base (872)..(872): a, c, t, g, unknown or other
  misc_feature (872)..(872): n is a, c, g, or t
tcagctcgcgtgtccacgaccggtgctcgatttagagtatacatattgggtttgggggcttttcctgggctcctgctactctggctccgaggtgccagatgtgacatccagatcgacccagtctccactcctccctgtctgtcttctagtaggagacagacgtcaccgtatcctacgttcggccggtacaacgtcaacgtaacctagttacggtacctttaaaccgttttttaaagtcggtaactacaaacgacggaccgaaccccgaaacggaaaaccccgcccccttaaaacctccgtaagttacgttttaagtcgggtacacttaccgtaccgttaactttcggaacggtaacggttccgtacccgtaataccggtaggtacgtaggtcggtacgtaggtcgtacggtcggtacgggactacggttacctttaccctaccttaccgaaccctagacgtaccgtacggtcttaaccgacggtaaccttaaaccgttaacgggaaccctttacgtttaaccgtaacttaaacccgtttacgtaaccttcccggtaaggtccttaacccggttaacgtaccgttaaccggggtaccgggttacccggggtaaccccgggtttccgtaaccccgggtacggggtaacccggggttaaaccggggacgggaaccggttcgggtacggtaacggttaaccggtaacggttacccgtagtaccggggtaactcccgggttaacaccgttaccttcccggttaagttttcccggaccgtttacgtccccgttaccgacccccgttgtaaacccggtgtaacccgacggactccggacgtcgttacgggacgaccgggtcgacggtaggcgtaaccgngtaccg

SEQ ID NO: 101482 - DNA, 1178 bp, Homo sapiens
  misc_feature: GYAE6OF01CSI6I.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatcgacccagtcctccacttcctccctgtctgtctttctaagtaggagacagtagtcaaccatcctacgttcggaccgggactaaacgttgacgtaaccctatttacgtaccttaacccttttttaaagttggtaatacctaaacgacggaaccgaccccgtaaaacgggaaaaccccgtacccccccgtaaaaccttccgttagttaacgtttttaaggccggttagcctaacttcccgtttacgttacggaaccggtaaacggtttaccgggggttaccctaaggtttaccgtaaacgggttacggtacggtacggggtacgtaacgggttgggttaccgttaccggggttaccggggtaaccgttaacggtttaccctttacccccgtaaacccctttcccgaaacccgttaaccggtaccgtaacggaccggttaaaccggttccgttaccggttaaccgttaaacccggttaaacggggtaacttttaaccccggtttaaccgttaaacccgttttaaccgtttaaccggtttaccgtttacccggttaaccggtaaccgtacctttacccggttaaccgttaaacgggggttaccggggtttaacccgggccccgggggtttaaaacccgttttcccggggtttaaccgggggtacccggggtaaaccggggggtaaacccggttaacgggtaacccgggttaggggtaaacggtaaacccgggtttaaaccgggaaacccggtttaccgggtttaacgggttacccgggtaaccggttaaccccggtcggtttaaaccccccgtttagttacccccgggtttttaccgtttaacccgtttaccccggttttaacccctttacccccggggttaaacccctttaacccggttaaaccggtttaaaccgaaccccggggtaaacgggtaaacccccgggtaccccggtttaacgggtcccccgggtaaacgggttaaaccccccgggggtgggtaaacccgggggtttaccccggaaacgggggaaccccgggtttaaccgggaacccgtttaaacccgggg

SEQ ID NO: 101483 - DNA, 787 bp, Homo sapiens
  misc_feature: GYAE6OF01B5E1E.8.67.G01.1.454.CMB.1.raw
  modified_base (649)..(649): a, c, t, g, unknown or other
  misc_feature (649)..(649): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgtcttctataggagacagacgtcaccatctacgttcggccgggacaagtcacgacctattacgtcttaaccttttaagttaggtactacaacgagacgacccgaaacggaaaccgaccccctaactccttagtatttaggtcggtacgactacttccttagtttcgaacgtaagggttccgggtaccctagtacgtaacggttcgaggtgtacgacggtaggtaccgtacggtacgggtcaacgtttacctttacccacccctaccgaacccgtacgtaccgaacgtcgtacggttaccgtacgtaacccgtaaccgtaacggtaaacgtttaccgtttaccggtaaccttaaaccgtttaccgttacctacggtaccgacgtacgttacgtttaaccgttacggaaccgggtaccgggtcccgggtaaccttaccgggttacgggaccggtaacgggacgtaagtcgagggaaccgtaggacccgtaaaccggtgtcggtacgtcgtacnccgtaacttcgttcgtaccgtttactaccgttccgtttaacccgtcgtacccgacttcccgttaagtcccggaacctacgccgggtcccagggtccgttacgggaccgggcggttaccggaggtacccgaggtaccgg

SEQ ID NO: 101484 - DNA, 523 bp, Homo sapiens
  misc_feature: GYAE6OF02IR4YN.8.67.G01.1.454.CMB.1.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagttctaaccatcacttggccgggcaagtcagaccattagctacctttttaaagtggtatcaacagacgcccaggaaaacncccccaaatcctgatttanggtncatccatttcgcaagtgggtcccatcaaggttcagtggcagtggatctgggcagatttcacctnaccatcagcagtctgcaactgaagactttgcaactttactactgtcagcagtcttacagtacggccggctaccgtttggaccgtacggggacgaaagccgtaggaacgtactacgaacgaactcgtgctgacacccatctcgttcttcactccttcccgcatcngacgcaccgcgagcgngacgcgggctgggcaggcacg

SEQ ID NO: 101485 - DNA, 484 bp, Homo sapiens
  misc_feature: GYAE6OF02JGLRC.8.67.G01.1.454.CMB.1.raw
  modified_base (454)..(454): a, c, t, g, unknown or other
  misc_feature (454)..(454): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagtagtcaccatcacttgccgggcaagtcagaccattagcacctttttaaattggtagtcaacagagcccaggaaaagccccccaaaactcctgatttatggtgcatccatttcgcaaagtcgggtcccatcaaggttcagtggcagtggatctggggcaggatttcacctcaccatcagcagtctgcaactgaagctttgcaacttactactgtcagcagtcttacagtagccggcacttgccagggacagctggagatacgacgaactgtgctgcacatctgtcttcatcttccgcatcngagcacgcgagctgagcggctggcaggcac

SEQ ID NO: 101486 - DNA, 499 bp, Homo sapiens
  misc_feature: GYAE6OF02I4BPH.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtgggtcccatcaaggttcagtggcagtggatctggggcagatttcaccctcaccatcagcagtctgcaacctgaagactttgcaactttactactgtcagcagtcttacagtaggccgggcacctttggccaggggacgaagctggagatcgaacgaactgtggctgcaccatctgtcttcatccttcccgcatctgagcacgcgagctgacgcgggctgggcaggcacg

SEQ ID NO: 101487 - DNA, 509 bp, Homo sapiens
  misc_feature: GYAE6OF02G4UIV.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgacaacttactactgtcagcagtcttacagtacggccggcaccgtttggccgaggggacgaagcgtggagatcgaacgactgtggctgcaccatctgtcttcatccttcccgctatctgacgacacgcgagcgtgacggcgggctgggacaggcgacg

SEQ ID NO: 101488 - DNA, 500 bp, Homo sapiens
  misc_feature: GYAE6OF02HGUQM.8.67.G01.1.454.CMB.1.raw
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
  modified_base (452)..(452): a, c, t, g, unknown or other
  misc_feature (452)..(452): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttanggtgcatccatttcgcaaagtgggtcccatcaaggttcagtggcagtggatctggggcagatttcaccctnaccatcagcagtctgcaacctgaagactttgcaaacttactactgtcagcagtcttacagtaggccggcaccgtttggccaggggacgaagcgtggagatacgaacgaactgtggctgcaccatctgtcttnatctccgcatctgacgacacgcgagctgagcgggctggcaaggcgacg

SEQ ID NO: 101489 - DNA, 554 bp, Homo sapiens
  misc_feature: GYAE6OF02G3K1X.8.67.G01.1.454.CMB.1.raw
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctcctgtctgctttctataggagactagagtcaccatcacttgccggcaagtcagaccattaggctacctttttaaatggtatcaacgagancccaaggaaaacgcccccaaatcctgatttanggtncatccatttcgacaaagtgggtcccatcaaggttcagtggcagtggatcgtggggacagtatttcacccgtnaccattcagctagtctgacaaccgtgaagtactttgactaacttctactgtcagcagttcttacagtaggccggctaccgttggaccaggggacaagctaggaagattacgaacgaactggtacgctcgacaaccagtcgtgttccgttacacttccttcccgcagttcgtaggacgacgacggtccgagtacgtggacggtccgggctcgggacgacggcgtacg

SEQ ID NO: 101490 - DNA, 515 bp, Homo sapiens
  misc_feature: GYAE6OF02HFNH5.8.67.G01.1.454.CMB.1.raw
  modified_base (470)..(470): a, c, t, g, unknown or other
  misc_feature (470)..(470): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaaactcctgatttatggtgcatccatttcgcaaagtggggtcccatcaaggttcagtggcagtggatcgtggggcagatttcaccctcaccatcagcagtctgcaacctgaagactttgctaacttactactgtcagctagtcttacagtacggccggcaccgtttggccgaggggacgaagcgtaggagagtacgaacgaactgtggctgcaccatctgtcttcatcctccgcntctgacgtacacgcgagcgtgacggcgggcgtggacgaggcgacg

SEQ ID NO: 101491 - DNA, 495 bp, Homo sapiens
  misc_feature: GYAE6OF02F2A6O.8.67.G01.1.454.CMB.1.raw
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaatcctgatttatggtgcatccatttcgcaaagtgggtccatcaaggttcagtggcagtggatctggggcagatttcacctcaccatcagcagtctgcaacctgaagactttgcaactttactactgtcagcagtcttanagtaggccgggcacctttggccaggggacgaagctggagatcgaacgactgngctgcacatctgtcttcatctcccgctatctgacgacacgcgagctgacgcgggctgggcaggcgacg

SEQ ID NO: 101492 - DNA, 504 bp, Homo sapiens
  misc_feature: GYAE6OF02F7NK2.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtgggtcccatcaaggttcagtggcagtggatctggggcagatttcaccctcaccatcagcagtctgcaacctgaagactttgcaactttactactgtcagcagtcttacagtacggccgggcaccgtttggccgaggggacgaaggctggagagtcgaacgaactgtggctgcacatctgtcttcatcctcccgcatctgagacacgcgagctggagcgggctggcgaggcgacg

SEQ ID NO: 101493 - DNA, 641 bp, Homo sapiens
  misc_feature: GYAE6OF02GJRIG.8.67.G01.1.454.CMB.1.raw
  modified_base (242)..(242): a, c, t, g, unknown or other
  misc_feature (242)..(242): n is a, c, g, or t
tcagctcgcgtgtccacgaccggtgctcgatttagagtatacatagttgggttggggctttcctgggctcctgctactctggctccgaggtgccagatgtgacatccagactgaccctagtcctccatcctcccgtgtcctgcgtttctataggagtacagagtcacatcacttgccggcaagtcaggaccattaggctacctttttaaagtggtaatccaacgacgagcccaaggaaaacncccccaaactcctgatttatggtgcactccatttcgctaaagtggggtcccatcaaggttcagtggcagtggagtacgtgggcagatttcacctcaccatcagcagtctgcaactgaagtctttgactaacttacactgtcagcagtcttacagtacggccggactacctttggaccgacggggacgtaacgtccgtaggacgtatacgaacgtaacgtggtacggactcgacaaccgtagtccgttaggttacctttaccgaacgtttcccgtttaccccggtaccttaacgttccgttacgggtaacgggtaccgtaaccgggtcgggtaaccgggtcgttacgggacggtccgggggtaccgttacgggggacccgtaacggggtcccgtaaccgg

SEQ ID NO: 101494 - DNA, 615 bp, Homo sapiens
  misc_feature: GYAE6OF02GGFJF.8.67.G01.1.454.CMB.1.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
tcagctcgcgtgtccacgaccggtgctcgatttagagtatacatattgggtttgggggcttttcctgggactcctgctactctggactccgacggtgccagatgtgacatccagatgacccagtctcatcctccctgtctgcttctataggagacagagtccaccatcgacttgccgggcaagtcagaccgattagctacctttttaaaatggtactcgaacagagcccgaaggaaaacgcccccaaaactcctgtatttagnggtncctatccatttcgactaaagttggggtaccctagtcaaggttcgagtggcgagtggactcgtggggcagtagtttacaccctcacctatcagcagtctagacaacctagaagtactttcgactaacttactactgtacagaccagtacttaacgacgtaacggacccggtactaaccgtttcggaccgaggggacgaaggacgtaggacgtactacgaacgtaacgtggtaggctgcctaccgtattctgtcttcgacttcttacccgtactacttcgtacgtacgtaccgtaccgtaccgtacgtccgttaggacggtccgggtcgtcggacgtacgggcccgtacg

SEQ ID NO: 101495 - DNA, 505 bp, Homo sapiens
  misc_feature: GYAE6OF02IHWC1.8.67.G01.1.454.CMB.1.raw
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaagcccccaaatcctgatttatggtgcatccatttcgcaaagtgggtccatcaaggttcagtggcagtggatcgtggggcagtatttcaccctcaccatcagcagtctgcaacctgaagtctttgactaacttactactgtcagcagttcttacagtagcgtggctacgttggccgaggggacgagcgtggagagtacgaacgagtgnggcncgcacatctgtctcatcctccgctatctgacacgacgcgacgcgtcgacggcggcgcggcgaggcg

SEQ ID NO: 101496 - DNA, 801 bp, Homo sapiens
  misc_feature: GYAE6OF02JRMPL.8.67.G01.1.454.CMB.1.raw
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
tcagctcgcgtgtccacgaccggtgctcgatttagagtatacatagttgggtttgggggcttttcctgggctcctgctactctggctccgaggtgccagatgtgacatccagatcgacccagtctccatcctccctgtctgcttctataggagacagagtcaccatcacgttgccgggcaagtcagaccattacgctacctttttaaatggtactcaacagacgccaggaaaacnccccaaacgtcctgattatggtgcatccatttcgctaaagtggggtcccatcaaggttcagtcggcgaggtggatcgtggggcaggacttttcaccctnacctatcagcagtctcgacctaaccgtagaagtaccgttttcgactaaaaccgtttactaaccgttggttaccaacggtacctaaacggttacctttaaacgtacggttaccgggtacccgggtaccgttaacccgttttacgggacccggtaaggggggtaaccgtaaacgggtccgttacggggaaacggtacgtttaacccgggaaaccggtaaacgttcgggttaccgggtaccttacgggtacccgtaaccgtaacggtttcccggttacgggtttacccgtttaccgtaacgtttccccggtttaccccggtaccccgttaacgttttccggttaaccggttaacggtaaccccggtttaacggacccggttaacggtacccggttaacgggggtaacccgggtaaccgggggttcccgtttaacgggggacccggttaaccgggggacccgttaacccgg

SEQ ID NO: 101497 - DNA, 514 bp, Homo sapiens
  misc_feature: GYAE6OF02HWT8Q.8.67.G01.1.454.CMB.1.raw
  modified_base (440)..(440): a, c, t, g, unknown or other
  misc_feature (440)..(440): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaaactccctgattttatggtgcatccatttcgcaaagtggggtcccatcaaggttcagtggcagtggatcgtggggcagatttcaccctcaccatcagcagtctgcaacctgaagactttgacaacttactactgtcagcagtcttacagtaggccggctacgtttggccgagggacgaagcgtaggagagtcgaacgaacgtgngctgcaccatctgtcttcactcttcccgcatctgacgacacgcgacgcgtgacggcgggctcgggcaggcgacg

SEQ ID NO: 101498 - DNA, 497 bp, Homo sapiens
  misc_feature: GYAE6OF02GHF1O.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtgggtcccatcaaggttcagtggcagtggatctggggcagatttcaccctcaccatcagcagtctgcaacctgaagactttgcaacttactactgtcagcagtcttacagtaggccgggcaccgtttggccaggggacgaagctggagatcgaacgaactgtggctgcaccatctgtcttcatcttcccgcatctgagcacgcgagctgacgcgggctggcaggcgac

SEQ ID NO: 101499 - DNA, 502 bp, Homo sapiens
  misc_feature: GYAE6OF02FH28R.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcaccgtttggccaggggacgaagctggagagtcgaacgactgtggctgcacatctgtcttcatcttcccgcatctgacgacacgcgagctgacggcgggctggcagggcgacg

SEQ ID NO: 101500 - DNA, 508 bp, Homo sapiens
  misc_feature: GYAE6OF02FWXSS.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagccaaggaaaagcccccaaaactcctgattttatggtgcatccatttcgcaaagtggggtcccatcaaggttcagtggcagtggatctggggcagatttcaccctcaccatcagcagtctgcaacctgaagactttgctaacttactactgtcagcagtcttacagtaggccggcacctttggccaggggacaagctggagatcgaacgaactgtggctgcaccatctgtcttcatcttcccgactctctgacgcacgcgacgcgtgacggcgggtcgtggcgacggcgacg

SEQ ID NO: 101501 - DNA, 537 bp, Homo sapiens
  misc_feature: GYAE6OF02HW7EG.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaaacgccccccaaaactcctgattttatggtgcatccatttcgcaaagtggggtcccatcaaggttcagtggcagtggatcgtggggcagatttcaccctcaccatcagcagtctgcaacctgaagtattttgctaattttattactgtacaaagagactacaacaagtggaggctacttttcggcgaggggaccaagcgtaggaaggaaggaaacgaacgtgtggctgcaccatctgttcttctactccttcccgcctactctgagaccgacgccgagctggacggcgggcgtcggcgaacggcgacacg

SEQ ID NO: 101502 - DNA, 573 bp, Homo sapiens
  misc_feature: GYAE6OF02GKTG1.8.67.G01.1.454.CMB.1.raw
  modified_base (416)..(416): a, c, t, g, unknown or other
  misc_feature (416)..(416): n is a, c, g, or t
tcagctcgcgtgtccacgaccggtgctcgatttagagtatacatattgggtttggggctttcctggctcctgctactctggctccgaggtgccagaatgtgacattccagatgacccaggtctccatccctccctgtcgtgcttctataggagacagagtcaccagtcacgttcgccgggcaaggtcagaccattagcctacctttttaaatggtatcaacagtagcccaggaaaacgcccccaaaactcctagactttatggtgcatccatttcgcaaaggtgggtcccatcgaaggttcaggtggcaggtgggatcgtggggactagatttcgaccctcaaccatcagcagtctgcaactgaatactttgactaacttactactgtacagacacgttcttacacgtaggccggntaccgtttggccgaggggacgaaggcgtagggagacgtcgaacgtaacgtgtggctgcactatcgttgtcttctattccgttcccgtctacgttcgtcggacgacgaccgtcggacgtccgtaggacggcgggtcgtcggaccgtaacggccgtacg

SEQ ID NO: 101503 - DNA, 500 bp, Homo sapiens
  misc_feature: GYAE6OF02F3KL8.8.67.G01.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacncccccaaactcctgatttatggtncatccatttcgcaaagtggggtcccatcaaggttcagtggcagtggatctggggcagatttcaccctcaccatcagcagtctgcaacctgaagactttgcaacttacactgtcagcagtcttacagtaggccggcacctttggccgaggggacgaagctggagatcgaacgactgtggctgcacatctgtcttcatcttcccgcatctagagacacgcgagctggacgcgggctggcgaggcgtacg

SEQ ID NO: 101504 - DNA, 507 bp, Homo sapiens
  misc_feature: GYAE6OF02GYPFS.8.67.G01.1.454.CMB.1.raw
  modified_base (471)..(471): a, c, t, g, unknown or other
  misc_feature (471)..(471): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagccccccaaaactcctgatttatggtgcatccatttcgcaaagtgggtcccatcaaggttcagtggcagtggatctggggcagatttcaccctcaccatcagcagtctgcaacctgaagtactttgactaacttactactgtcagcagtcttacagtacggccggctaccgtttggccgaggggacgaagcgtaggagatcgaacgactgtggctgcaccatctgtcttcactctcccgcatcngacgcacgcgagcgtgacgcgggctggacaggcacg

SEQ ID NO: 101505 - DNA, 517 bp, Homo sapiens
  misc_feature: GYAE6OF02H5MW4.8.67.G01.1.454.CMB.1.raw
  modified_base (450)..(450): a, c, t, g, unknown or other
  misc_feature (450)..(450): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtggggtcccatcaaggttcagtggcagtggatcgtggggcagatttcaccctcaccatcagcagtctgccaacctgaagtactttgctaacttactactgtcagcagtcttacagtacggccggctaccgttggccgaggggacgaagcgtaggagagtacgaacgaactgtggctgcacntctgtcttcatcttcccgctatctgacgacacgcgacgctggacggcgggacgtcggcgaggcgacg

SEQ ID NO: 101506 - DNA, 506 bp, Homo sapiens
  misc_feature: GYAE6OF02G52WO.8.67.G01.1.454.CMB.1.raw
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaaacagagcccaggaaaaacgcccccaaaactcctgattttanggtgcatccatttcgcaaagtggggtcccatcaaggttcagtggcagtggatctggggcagatttcaccctcaccatcagcagtctgcaacctgaagtactttgcaacttactactgtcagcagtcttacagtaggccgggcaccgtttggccaggggacgaagctggagatcgaacgacgtgtggctgcaccatctgtcttcatctccgcatctgagacacctgacgcggcgtcggcgaaggcgacatagc

SEQ ID NO: 101507 - DNA, 801 bp, Homo sapiens
  misc_feature: GYAE6OF02HE4TU.8.67.G01.1.454.CMB.1.raw
tcagctcgcgtgtccacgaccggtgctcgatttagagtatacatagttggggtttggggctttcctgggctcctgactaactctggctccgaggtgccagatgtgacatccagatgacccagtctccatcctccctgtctgcttctataggagacagagtcaccatcacttgccgggcaagtcagaccattagctaccttttaatgtatcaacagacgcccaaggaaaacgcccccaaaactcctgtattttagtggtcgcactccaattttcgctaaaggtcggggtaccccagtccgaaaggttaccaaggtcggctacggttcggaactccgtggggacctaggtacttttccaaccccgttccgaccaacgttccgaacggtacctagttcctacggaccgtaaaccccgttagggaaacgttaccgttttcggaacccttaaaaccttttaaccgtaaccgtttcgtacctaacggtacctaacggtttccttaacgacggttaaccggggcccggggtaccgttaaccccggttttcggggaccccgggtaacggggggtaaccgtaaacgggtccgttagggtaacggtaaacgttaccggtaaaccgtaacgttacgggttacgggaccttaggaccctaacccgttacgtttaccgttcggtttacctttccgtaacttccccgtttaccccggtacctacgttccgtacggaaccggtaacccgtaaccggtaccggacggtcgtagggacggtaccgggtcggttaccgggacggtaccgggcgtaaccg

SEQ ID NO: 101508 - DNA, 515 bp, Homo sapiens
  misc_feature: GYAE6OF02G0TAZ.8.67.G01.1.454.CMB.1.raw
  modified_base (249)..(249): a, c, t, g, unknown or other
  misc_feature (249)..(249): n is a, c, g, or t
  modified_base (460)..(460): a, c, t, g, unknown or other
  misc_feature (460)..(460): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttanggtgcatccatttcgcaaaggtggggtcccatcaaggttcagtggcagtggatcgtggggcagtatttcaccctcaccatcagcagtctgcaactgaagtctttgactaacttactactgtcagcagtcttacagtacggccggctaccgtttggccgaggggacgaagcgtggagacgtacgaacgactgtggctgcacatctgtcttcnctcctcccgcactctgacgcacgcgagctggacgcgggctcgggacacggcgacg

SEQ ID NO: 101509 - DNA, 489 bp, Homo sapiens
  misc_feature: GYAE6OF02GSRRL.8.67.G01.1.454.CMB.1.raw
  modified_base (486)..(486): a, c, t, g, unknown or other
  misc_feature (486)..(486): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctgggcagatttcacctcaccatcagcagtctgcaacctgaagctttgcaacttactactgtcagcagtcttacagtaggccggcacctttggccaggggacgaagctggagatcgaacgactgtggctgcacatctgtcttcatcttccgcatctgagcacgcgagctgacgcggctggcaggnacg

SEQ ID NO: 101510 - DNA, 555 bp, Homo sapiens
  misc_feature: GYAE6OF02H69P4.8.67.G01.1.454.CMB.1.raw
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaaggaaaacgcccccaaaatcctagattttanggtgcatccatttcgcaaagtgggtccatcaaggttcagtggcagtgatctggggcagntttcacctcacatcagcagtctgcactgaagcttgctaatactactgtacagcagttcttaacgagtaggcccggtactacccgtttggaccgacggggacgaaggcgttaggaacgtacgtaccgaaacggaacttggtggcgtagcctaaccgtagtctacgtcctttacgacttctcccgtccacgttctagacgacacggcgtacgctaggacgcgggtctcgggacgtacggcgtacg

SEQ ID NO: 101511 - DNA, 631 bp, Homo sapiens
  misc_feature: GYAE6OF02HTBAI.8.67.G01.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatttggtatcaacagagaccccaaggaaaacgacccccaaactcctgtattttatggtgcatccatttcgacaaagtggggtcccatcaaggttcagtggcagtggatcgtggggcagtntttcnccctcaccatcagcagtctgacaacctgaagtactttgacaacgtttactctgtacagctagttctttacaggtacggccgggctaccgtttggccgaggggacgaagcgtggagacgtacgaaccgaacgttggtggacctcggacctaaccgtacttaccgttcgttacctttaccaccgtttacccttcccccgtacctaacgttcccgttaggaaccggaacccgaccggtacggtaccggtacgttacgggacggggtcccgggggccgtacggggtaaccgaccggggcggtaaccg

SEQ ID NO: 101512 - DNA, 605 bp, Homo sapiens
  misc_feature: GYAE6OF02FQW3S.8.67.G01.1.454.CMB.1.raw
tcagctcgcgtgtccacgaccggtgctcgatttagagtatacatattggggtttgggggcttttcctgggctccctgctacgtctggctccggaggtgcctagatgtgacatccagatgacccagtctccatcctccctgtctgcttctataggagacagagtcaccatcacttgccgggcaagtcagaccattagcactttttaaatggtatcaacgagacgcccaggaaaacgcccccaaactcctagattttatgggtgctatcctatttccgcaaagttggggtcccagtcaagggttcagtggcagtggactcgtggggcaggatttcgaccctcgaaccatcagcagtctgctaacctgaagtctttgactaactttacctactcgtcagccagtcttacagtacggtccggactaccgtttggaccgaggggacgaacgcgtacgggaacgtacgtaccggaacgaacgtggtacggacttacgcctaccgacgtccgttacggtccttacgtacttcccgttacccgtcctacgttccgtagacgtacgaccggtcgaagtcgtggacggcgggtcgtagggcgtagggtccgtacg

SEQ ID NO: 101513 - DNA, 981 bp, Homo sapiens
  misc_feature: GYAE6OF02IPY1M.8.67.G01.1.454.CMB.1.raw
tcagctcgcgtgtccacgaccggtgctcgatttagagtatacataattgggtttgggggcgggttttcctgggactccgtgctactctggcgtccgaggtgccagatcgtggacatccagatgacccagtctccactcctccctgtctgcttcgtatagggacgacagagtccaccatcacttcgccgggcaagtcagaccgattacgctaacctttttaaagttggtaatccaaacagtacgcccaagggaaaaacgtcccccgaaaactcctagtatttatgggttgacctaatcctaagtttcgcgtaaaaggttcggggtacccctaactccgaaagggttccaacggttccggacctaaggtagggtaacttcggttagggggacgtaacgtacttttaccgaccccgttaccgtaacccgtaagtttccgaacggtccctaacggtttccgttacggacccgtaaaacccgttacggtaaaacggttaccttttacgggaacccttaaaaacccgttttaacccgttaacccgttcgtttacccgaaccggtaaccgttaaccgtttcccgtttaaaccggtaaccggttaaccggggtaccccggggttaccccgttaaccccgggttttaacggggaaccccggggtaaacggggggtaaaccgggtaaaccggttacggtttaacgggtaaacgggttaacggttaacccggtaaaaccgggtaaccggtttaacgggttccgggaccgtttacggacccgtaaaccggttaacttaacccgggttttacggtttaccgttttaccggaacggttttaccccgggttacccccgggtaaccgttaacggttacccggttaacgggtaccggtaaacccggttaaccgggacccgggtaacgtacccggtacgggtacccggggtcccggggtaccgtttacggggaccccgtaacggggtcccctaacccgg

SEQ ID NO: 101514 - DNA, 570 bp, Homo sapiens
  misc_feature: GYAE6OF02HR032.8.67.G01.1.454.CMB.1.raw
  modified_base (328)..(328): a, c, t, g, unknown or other
  misc_feature (328)..(328): n is a, c, g, or t
tcagctcgcgtgtccacgaccggtgctcgatttagagtatacataattgggtttgggggcgttttcctgggctcctgctactcgtggctccgaaggtgccagatgtgaccatccagattgacccagtctccatcctccctgtctgcttctagtaggagacagagtcaccatcacttgccgggcaagtcagaccattagcacctttttaaatggtatcaacagagcccaaggaaaaacgccccccaaaactccctagaattttatggtgacatccatttcgactaaagtgggtccatcaaggttcagtggcagtgatcgtggggcagtntttccacctcaccatcagcagtctgcaacctgaacgtctttgactaacttactacgtgtcagctagtttcttacgagtacggccggctaccgtttggaccgaggggacaggccgtagggagtagtacgaacgtacgtggtcggtactgactaccattcttgttcttactacttccttacccgcctatcgtagaacgacaccggacgagtcgtagacggcgggtcgtgggacacgggctaacg

SEQ ID NO: 101515 - DNA, 573 bp, Homo sapiens
  misc_feature: GYAE6OF02HZRRW.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagccccaaggaaaacgcccccaaaactcctgattttatggtgcatcctatttcgacaaaggtggggtcccatcaaggttcagtggcagtggatcgtggggcagtatttcaccctcaccatcagcagtctgacaacctgaacgtctttgactaactttactactgtcagctagtcttacacggtacggccggctaccgtttcggccgaggggacgagcgtaggagacgtacgaaacgtacgtggtggcgtgaccacgatcgttgtccttctacttccgttcccgacctacttcgtacgacgaccgtaccggacgacgtccgtggacgggccgggtcgtacgggacgacgggcgtacg

SEQ ID NO: 101516 - DNA, 504 bp, Homo sapiens
  misc_feature: GYAE6OF02FR95F.8.67.G01.1.454.CMB.1.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgatttatggtgcatccatttcgcaaagtggggtcccatcaaggttcagtggcagtggatctggggcagatttcaccctnaccatcagcagtctgcaacctgaanctttgcaacttactactgtcagcagtcttacagtaggccgggcaccgtttggccaggggacgaagctggagatcgaacgaactgtggctgcacatctgtcttcactcttcccgccatctgacgcacgcgagctgacggcgggcgtggacgaggcgacg

SEQ ID NO: 101517 - DNA, 614 bp, Homo sapiens
  misc_feature: GYAE6OF02H1HRI.8.67.G01.1.454.CMB.1.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
tcagctcgcgtgtccacgaccggtgctcgatttagagtatacatattgggtttgggggcgttttacctgggctcctgtcgtacctctgggactccgaggtagcccagatgtgactatcctagactgacccagtctcgatcctccttgtctgccttcgtataggagtacagtagtcaccatcacttgcccggcaagtctagaccattaggactaccgttttaaatcggtatccaacagagcccaggaaacnccccaaatcctgatttactggtancagtccaattcgacaagtcgggtccatcaaggttccagtgcagtggatctgggcagtcttccacctnaccatcagcagtcngcactgagtnttgactaacttactactntacacgctagtctagtagtacggccggtcgtacgttcggacgtaaggggactaacggtcgtaggtaacgttacgtaccgaacgtaactaggtcggcctacggacctaccgtacgttccggtacgttccgttaccgtaccgttccgttacccgacgtacgtcgtaacgtacgtaaacgccgtaggtacgtcgtacggacggccgggtactcgggtacgtacggtaccgtacg

SEQ ID NO: 101518 - DNA, 505 bp, Homo sapiens
  misc_feature: GYAE6OF02GBEQL.8.67.G01.1.454.CMB.1.raw
  modified_base (440)..(440): a, c, t, g, unknown or other
  misc_feature (440)..(440): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagccccaaggaaaacgcccccaaaactcctgattttatggtgcatccatttcgcaaagtgggtcccatcaaggttcagtggcagtggatctggggcagatttcaccctcaccatcagcagtctgcaacctgaagactttgactaacttactactgtcagcagtcttacagtaggccgggctaccgtttggccgaggggacgaagcgtggagatcgaacgactgnggctgcacatctcgtcttcatcctcccgcatctgacgcacgcgagcagcgcggctggcaggcacg

SEQ ID NO: 101519 - DNA, 721 bp, Homo sapiens
  misc_feature: GYAE6OF02IX4DM.8.67.G01.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
tcagctcgcgtgtccacgaccggtgctcgatttagagtatacatattgggttggggctttcctgggctcctgctactctggctccgaggtgccagatgtgacatccagatgacccagtctccatcctccctgtctgcttctataggagacagagtcaccatcacttgccgggcaagtcagaccattagcaccttttaaatgtatcaaacnacnccaagaaccacccaaatccatattagtgtgacactcctattcactaaggtcggtaccagtacgtaaggttcaaggtcggctaggtagagttcggtagggtactagggtacttaccgacccttacacctacgtaccacgtacgtacgtcgtacgacctaaccgtaggaaacgttacgtttacgaacctttaaacgttacctaaccgttcgtaccaacgtactacgttacttacgtacggtaacgggacccggtaccgttaccggttcggaaccgggtaacgggaacgtaacggacgtagggaacgtacgtaaccggaaaccggttacggtacgggtacggtacgtggtaccgtaaccgtaccgtaccgttacgttaccgtttacgtaccgttacccgttaccccgtaccgtaccgtaccgtaccgtaccggtaaccgtaaccgtacggtaaccgtaccgtacggtacggtaccgggtaccggtacgggtaccggtaccggaacggtacg

SEQ ID NO: 101520 - DNA, 528 bp, Homo sapiens
  misc_feature: GYAE6OF02HZ620.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaacgcccccaaactcctgatttatggtgcatccatttcgacaaagtggggtcccatcaaggttcagtggcagtggatcgtgggggcagatttcaccctcaccatcagcagtctgacaacctgaagacttttgactaacttactactgtcagcagtcttacagtaggccggctaccgtttggccgaggggaccgaagcgtaggagagtacgaaacgaactggtgctgcaccatctgtcttcactccttcccgctatcagagacacgcgacgtctaggacggcgggcctgggacacgggcgacg

SEQ ID NO: 101521 - DNA, 528 bp, Homo sapiens
  misc_feature: GYAE6OF02I62GU.8.67.G01.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgcccccaaaactcctgatttatggtgcatccatttcgcaaagtgggtcccatcaaggttcagtggcagtggatctgggcagatttcaccctcaccatcagcagtcngcaacctgaanactttgcaattctatgcagctagtcttacagtaggccgggtcaccgtttggaccgaggggacgaaggcgtggagagtacgaacgaacgtgtggctgcaccatctgtcttcacttccttcccgcctatctcgacgacgacgcgagtccgtggacggcgggtcctcgggacgtacggcgtacg

SEQ ID NO: 101522 - DNA, 507 bp, Homo sapiens
  misc_feature: GYAE6OF02GR1KX.8.67.G01.1.454.CMB.1.raw
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaaactcctgattttatggtgcatccatttcgcaaagtggggtcccatcaaggttcagtgcagtggatctggggcagatttcaccctcaccatcagcagtctgcaacctgaatactttgacaactttactactgtcagcagtcttacgagtagggccggctaccgtttggccgaggggacgaagcgtggagatcgaacgactgngctgcaccatctgtcttcatcctccgcatcngacgcacgcgagctgacggcgggctgggacaggcacg

SEQ ID NO: 101523 - DNA, 911 bp, Homo sapiens
  misc_feature: GYAE6OF02GSIZ7.8.67.G01.1.454.CMB.1.raw
  modified_base (277)..(277): a, c, t, g, unknown or other
  misc_feature (277)..(277): n is a, c, g, or t
tcagctcgcgtgtccacgaccggtgctcgatttagagtatacataagtttgggggttggggctttacctcgggctcctgcttactcgtggctcccgagggtgccagacgtgtgaccatccaagattgacccagtccttcccatcctcccttgtctcgcttctagtacggacgacagggtagtccaccatcacgttgcccgggaactaacgtcagacctattaggcctaaccgtttttaaaatgggtatcgaacctaggacgcccgaacggtaaaacncccccctaaaactccctgtatttaactggttcgaccggtaaattccgtacgtttccgacgaaaaggtacggggtaccctagttacgaaaggtttcaagttggcaaggtcggagtcgtggggcctaggaattttccgacccttcgaaaccgtacttacgtaacgtcctaacgttcgttcggtaacctaaaccgttaagggtaaacttaagtttttcggaaccttaaaagtttttaactttaaccgttgggttaacgaaaagggtacggttaaccctttaccgtaaaccgtaaacgttaacgggtaaccggtaaccccgttaaaccggtttttaaccgggaaccccggttaaaccgggggtaaaacccgtaaaacgggttacccggttaacggggtaaaccggttaaacccgggtaaaaacccgttaaaccgttaacggttacgggtaccgttacgggtaccctaacccgtaaccgttaccgtaccgtttacccgtttaccgttaacgttttaccgttttccccggtaaccgtacgttaccggttacggtaacgtaaccgtaacggtaccggtacggtccgttacggtacggtaccgggtacgtaccgggtaccgtaacgggtccgacggtaacgg

SEQ ID NO: 101524 - DNA, 584 bp, Homo sapiens
  misc_feature: GYAE6OF02JODTQ.8.67.G01.1.454.CMB.1.raw
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagccccaaggaaaacgcccccaaaactcctagtacttttaatggtgacatccattttcgacaaaggtgggtcccatcgaaggttcagtggcagtggatcgtgggacagtatttcaccctnaccatcagcagtcngaccactgaaagtctttgactaacttatactgtacaggactagtactacgaggtacggccggtactacccgtttggaccgtagggtacgaagcctagggagacttacggaacgtacgtcgttcgcgtcgaccacctacgtcgtaccgttacttctacttccttcccgacacgttcgtacggacgaaccgtacggcgtacgtcgttagacggtcggtacgtgaccgtacggcacg

SEQ ID NO: 101525 - DNA, 625 bp, Homo sapiens
  misc_feature: GYAE6OF02IBINK.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaaattggtatcaacagagaccccaagggaaaacgccccccaaaatcctagattttatggtgcatccattttcgcaaagtggggtcccatcaaggttcagtggcagtggatcgtggggcagattttcaccctcaaccatcagcagtctgacaaccttgaacgacttttgacctaacttaactactgtacagcagttacttaacacggtaacgggcccgggactaccgttttagggaccgtaagggggacgaaacgcgtagggagaagttacgaaacggaacgtggtacggactggtaccaaccgtacgtccttcgtcctttacgtacttcccgttccccgacctacgttaccgtacgtaacgacgtaaccgccggagccgttagggcgggtccgggtacgacgggtcgaaaccggggcgaacgg

SEQ ID NO: 101526 - DNA, 523 bp, Homo sapiens
  misc_feature: GYAE6OF02GTWXE.8.67.G01.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (449)..(449): a, c, t, g, unknown or other
  misc_feature (449)..(449): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaactcctgattttanggtncatccatttcgcaaagtggggtcccatcaaggttcagtggcagtggatcgtggggcagatttcaccctcaccatcagcagtctgcaacctgaagtactttgacaacttactactgtacagcagtcttacagtacggccggcaccgtttggccgaggggacgaagctaggagatacgaacgactgtggctgccacntctgtcttcacttccttcccgctatcgtagacgacgacgcgacgtctggacggcgggtcgtggacgaggcgacg

SEQ ID NO: 101527 - DNA, 609 bp, Homo sapiens
  misc_feature: GYAE6OF02IHF2Z.8.67.G01.1.454.CMB.1.raw
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (601)..(601): a, c, t, g, unknown or other
  misc_feature (601)..(601): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaatccngtaattttanggtnacatccatttcgcaaaggtgggtccatctaaggttcagtgcagtggatcgtggggcagatttcacccgtcaccatacagcagtctgaccaacctagaacgtactttgactaaaccgtttactacgtgtacagtctaagttcttaacgacggtacggtccgggtactaccgtttggaccgaggggtaacgacggtcgtaggagacgtacgaacgtactgtaggcgtcgacctaacctatccgttacgttcttacgacttcccgtacccgcctagtccgtaggtaaccgaccgacggcggtaacgtcggttaggacgggaccgggcgttacggacggtaacgggngtaaccgg

SEQ ID NO: 101528 - DNA, 526 bp, Homo sapiens
  misc_feature: GYAE6OF02HVGQF.8.67.G01.1.454.CMB.1.raw
  modified_base (382)..(382): a, c, t, g, unknown or other
  misc_feature (382)..(382): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaatcctgatttatggtgcatccatttcgcaaagtgggtcccatcaaggttcagtggcaggtggatcgtggggcagatttcaccctcaccatcagcagtctgacaacctgaagtactttgactaacttactactgtcagcagtcttanagtacggccggctaccgttggcgaggggacgaagcgtaggagatacgaacgactgtgctgcaccatctgtcttctactccttcccgcactctagaacgcaccggcgagtccgtggacggcgggtccgtgggaccgaggccgacg

SEQ ID NO: 101529 - DNA, 621 bp, Homo sapiens
  misc_feature: GYAE6OF02F4U1J.8.67.G01.1.454.CMB.1.raw
  modified_base (344)..(344): a, c, t, g, unknown or other
  misc_feature (344)..(344): n is a, c, g, or t
  modified_base (545)..(545): a, c, t, g, unknown or other
  misc_feature (545)..(545): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattacgcttaacttttaagttgtatacaacgagacgacccgaaaggaaaaccgaccccctaaactcctagtattttagtggtgctactcctagtttccgactaaagggtcggggtaccctatacgtaacggttcaggtcggactaggtggacttcggnggggaccagttactttccaccctcaaccatacagtacagtctcgacctaaccgtagaaacgttacttcgaactaactttactactgtacagactacgttctacgacgtacgggccggtactaccggttcggaccggagggacgagtcgtaggacgtacgacgaacgtacgtggtcgcgtcgccaactctcgtcgtcttacncttcccgttccgctactcgtagacgccgacggacgacggtcgaggacggcggtacgtcggaccgacggtccgaacg

SEQ ID NO: 101530 - DNA, 514 bp, Homo sapiens
  misc_feature: GYAE6OF02FWYXH.8.67.G01.1.454.CMB.1.raw
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaatcctgatttanggtncatccatttcgcaaagtggggtcccatcaaggttcagtggcagtggatctggggcagatttcacctcaccatcagcagtctgcaacctgaagtactttgctaacttactactgtcagcagtcttacagtaggccggctaccgtttggccgaggggaccgaagcgtaggagagtacgaacgacgtgtgctgccacatctgtcttcatccttccgctatctagacgacacgcgagtctaggacggcgggcgtggcacggcgacg

SEQ ID NO: 101531 - DNA, 597 bp, Homo sapiens
  misc_feature: GYAE6OF02H9SY6.8.67.G01.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattacgctactttttaaatggtatcaaanagagcccaaggaaaacncccccaaaatcctagattttanggtnacatccatttcgacaaagtgggtaccatctaaggttcagtgctagnggatcgngggcagtatttccaacctcaccatcaagcagtcgtncaactgaaacgtctttgactaaacttacgtacngttacgagtctattaccgttagtacggtaacggccggggtacaaccgtttcggaccggtaacggggtaacgtaaacgcgtacgggagtaacgtacgaacgaacgtagtggacgtcgaccgaactactacctgtaccttacaacttccgtcccgtacacttcgacgtacggaacaccggacgtacgaccgtggacgcgggctcgggacgacggcgacg

SEQ ID NO: 101532 - DNA, 581 bp, Homo sapiens
  misc_feature: GYAE6OF02JL6R0.8.67.G01.1.454.CMB.1.raw
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttatggtncatccatttcgacaaaggtcgggtaccatcgaaggttcagtggcaggtggatcgtggggcagtatttccacctcaccatcagcagtctgcaactgaatctttgactaacttactactgtacagtctagtcttagagtacggccggtctaccgttcggaccgagggacgagcgtaggagacgtacgaacggaacgttgtcggcgttcgacctaccgacgttcgttcggttcttactaccgttcccttacccggtacctattccgtaggacgtaaccgacggtcgaacgttccgtggacggcggtcgttacggacggacggaccgtacg

SEQ ID NO: 101533 - DNA, 511 bp, Homo sapiens
  misc_feature: GYAE6OF02FMHXI.8.67.G01.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaagccccccaaaactcctgatttanggtncatccatttcgnaaagtggggtcccatcaaggttcagtggcagtggatctggggcagatttcaccctcaccatcagcagtctgcaacctgaagactttgctaaactttacactgtcagcaagtcttacagtaggccgggcacctttgggcctagggggacgaagctgggagatacgaacgaactgtggctgcaccatctgtcttcatccttccgcatctggacgactacgcgagctggagcgggctggcaggcacg

SEQ ID NO: 101534 - DNA, 614 bp, Homo sapiens
  misc_feature: GYAE6OF02GB9ZO.8.67.G01.1.454.CMB.1.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctactttttaaatggtatcaaacagancccaaggaaaacgcccccaaaatcctgaatttatggtncatccatttcgcaaagtgggtccatcaaggttcagtggcagtggatcgnggggcagtatttccacctcacatcagcagtctcgacaacctggaaactctttagacctaaactttacgtactggtacaggacctagttaccttaacgaacggtacgggcccgggtctaacccggttttcgggaccggtaagggggaacggtaacggccgtaggacgaacgtaccggaaacgtaacgtggtacggctacgcctacctagttctcgttcttcacttccgttcccgcctaacttcgtagacggtaccgaacgtcgaacgtcgtacggacgggtcgggtaccgtgggacgaacgggcgtaacg

SEQ ID NO: 101535 - DNA, 622 bp, Homo sapiens
  misc_feature: GYAE6OF02I65XY.8.67.G01.1.454.CMB.1.raw
  modified_base (576)..(576): a, c, t, g, unknown or other
  misc_feature (576)..(576): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaaactcctagaattagtggtagcatccaatttcgacaaaaggtcggggttaccatacaaggttcagtggcagtggatcgtgggacagactttcacctcaccatcagcagtctgacaacctgaagactttgactaacgttactatcgtacacggtacagttacttaacgaacggtacgggaccgggtactaaccgttttacgggaccgtaggggggtaaccgaaggtaccgttagggaacgtaacgttaacggaacggtaaacgttggtacggtacgtacgacgaccctatacgttacggttcctttacgacttcccgttcccgactactcgtagacgaancggtacgacgcgtaggtacggccggtacgtggaacgacggcgtacg

SEQ ID NO: 101536 - DNA, 663 bp, Homo sapiens
  misc_feature: GYAE6OF02HPMAZ.8.67.G01.1.454.CMB.1.raw
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
  modified_base (399)..(399): a, c, t, g, unknown or other
  misc_feature (399)..(399): n is a, c, g, or t
tcagctcgcgtgtccacgaccggtgctcgatttagagtatacatattgggtttgggggctttttcctgggctcctgctactctggctccgaggtgccagatgtgacatccagatgacccagtctccatcctccctgtctgctttctataggagacagagtcaccatcacttgccgggcaagtcagaccattagctaacctttttaaatggtatcaacagtagccccaagggaaaacncccccaaaatcctagtattttagnggtgctatccattttcgacaaaggtggggtcccatcgaaggttcaggttggacagtggatcgtggggcaagtctttccaccgtcaccatcagcagtctgaccaactgaacgtactttggactaacttactactgtcancattctacgagtacggccggtcgttacgttcgacggtacgggacgaagcggtagaggaattccggaaactacgtaggtcggtactacgaccgtaaccgtacttacgttccgttacgtttaccgaccgtttcccgttccccggtacctttaacgtacccttacgggaacccgtaacgtacccgggtaccggtaacgttacccgttacgggggaccggtccggggggttaccgttacggggaccggttaacgggccggttaaccgg

SEQ ID NO: 101537 - DNA, 608 bp, Homo sapiens
  misc_feature: GYAE6OF02GI1TW.8.67.G01.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgctttctataggagacagagtcaccatcacttgccgggcaagtcagaccattagctacctttttaaaattggtatcaaacagagcccaaggaaaacncccccaaaactcctagattttanggtgcatccatttcgacaaaggtgggtcccatcaaggttcagtggcagtggatcgtggggacagtagtttccaccttcaaccatcaagcagtctgacaacctgaaatctttgactaaactttactactagtcaggcagttacttacgagtacggccggactaccgtttgggacccgaagggggaacgaaggccgtagggaagtacgtacgaaacgaactggtcggctcgaccaacctagttcttacgttcctttacgtaacttccgtttaccccgactacgtcgtacgaacggaaccacggaccgaagtccgtaggacgggccgggtacgtcggaccgtacggcgtaacg

SEQ ID NO: 101538 - DNA, 658 bp, Homo sapiens
  misc_feature: GYAE6OF02I6ZMI.8.67.G01.1.454.CMB.1.raw
  modified_base (259)..(259): a, c, t, g, unknown or other
  misc_feature (259)..(259): n is a, c, g, or t
  modified_base (603)..(603): a, c, t, g, unknown or other
  misc_feature (603)..(603): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctcccttgtctgcttctataggagacagagtcaccatcacttgccgggcaagtcagaccattagctaccttttaaatggtatcaacagagcccaaggaaaacgcccccaaaacgtcctggaacttttaagngggtgacctatccatttcgacaaaaggtcggggtaccatcaaggttcaaggtggactagtggatcgtggggcaagtatttccaccttcaaccatcagccagtctgacaacctgaacgtactttgaccaaactttactactgtaccaagactaggttaccttaacgaggtaacgggtacccgggtacctaccgtttacgggaccgtaagggggaacgtaaggtccgtagggaacgtaacgtaccggaaacgtaacgttggtacggccgttacgaccgaacctacgttacgtacgttacgttaccgtacttacccgttccccgactacgttccgtaggaacgtacnccgggtacgtacgtcgttacggacggtccgggcgtacggacggtacggtcgacgg

SEQ ID NO: 101539 - DNA, 583 bp, Homo sapiens
  misc_feature: GYAE6OF02G9EBF.8.67.G01.1.454.CMB.1.raw
  modified_base (346)..(346): a, c, t, g, unknown or other
  misc_feature (346)..(346): n is a, c, g, or t
  modified_base (531)..(531): a, c, t, g, unknown or other
  misc_feature (531)..(531): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaaactcctagattttatggtgcatccatttcgacaaagtcggggtacccatcaaggttcagtggcagtggatcgtggggcagtatttccacctcaccatcagcagtcngccaaccgtgaagtactttgactaactttactactgtacagtctagttcttacgagtacggccggtctaccgtttcgggaccgaggggacgagcgtggaagtactacggaaacgtaacgtggtcggtctgaccacctacttctcgttccttacacttccttacccgctactcgtacgacgaaccnccggacgacgtccgttgggacggtcgggaccgtgggacctacgggcgtacgg

SEQ ID NO: 101540 - DNA, 540 bp, Homo sapiens
  misc_feature: GYAE6OF02GDH8K.8.67.G01.1.454.CMB.1.raw
  modified_base (150)..(150): a, c, t, g, unknown or other
  misc_feature (150)..(150): n is a, c, g, or t
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctatagganacagagtcacccatcacttgccgggcaagtcagaccattagcacctttttaaatggtatcaacagancccaaggaaaacncccccaaatcctgatttanggtncatccattcganaaagtgggtcccatcaagtcagtgcagtgatcgtgggcagatttccacctcacatcagcagtctgcaactgaactctttgacctaacttacacgtgtacaagtctaagtcttacacggtaggccggtcaccgtttcgaccgaggggacgaagcgaggagtagtccggtaacgaacgtggtcgtctagcacctatcgtcgttacttcaccttccttaccgacctacgtccagacgaccacgccgagtctaggcgacggctagggactaggctaacg

SEQ ID NO: 101541 - DNA, 512 bp, Homo sapiens
  misc_feature: GYAE6OF02F48OX.8.67.G01.1.454.CMB.1.raw
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaaatcctgatttatggtgcatccatttcgcaaagtggggtcccatcaaggttcagtggcagtggatctggggcagatttcaccctcaccatcagcagtctgcaacctgaaagcttttgctaaacttactactgtcagcagtcttacagtaggccggctaccgtttggccgaggggacgaagcgtaggacgatcgaacgactgnggctgccacntctgtcttcactcttcccgcactctgacgacacgcgagcgtgacggcgggcgtgggacaggcgac

SEQ ID NO: 101542 - DNA, 563 bp, Homo sapiens
  misc_feature: GYAE6OF02IXGQM.8.67.G01.1.454.CMB.1.raw
  modified_base (231)..(231): a, c, t, g, unknown or other
  misc_feature (231)..(231): n is a, c, g, or t
  modified_base (392)..(392): a, c, t, g, unknown or other
  misc_feature (392)..(392): n is a, c, g, or t
  modified_base (460)..(460): a, c, t, g, unknown or other
  misc_feature (460)..(460): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaaactcctgatttatggtgcatccatttcgcaaagtgggtcccatcaaggttcagtggcagtggatcgtggggcagtatttccaccctcaccatcagcagtctgccaaacctgaacgtactttgactaacgtttactactgtcagctagttctancgtaggccgggactaccgtttggaccgaggggacgaaggcgtggagacgtacgaaacgtactgtcggngtgacctaccagttcctgttacttcacgttcccttcccgacctatcctacggaacgacgacgccgagcgtaggacggcgggtacgacgggacgtacggcgacg

SEQ ID NO: 101543 - DNA, 637 bp, Homo sapiens
  misc_feature: GYAE6OF02ITKUD.8.67.G01.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacttttaaatggtatcaacagagcccaaggaaaaccgcccccaaatcctagtatttagnggtncatcctatttcgactaaaggtcgggtacccatacgaaggttcaggtggcaggtggtatcggtggggactagtactttccacccttacacctatccgaagtctagttcctgaccaaccgtagaacgttactttgaacctaaacttactactgtacagctacgttcttaacgaggtacgggacccggtaccttaccggttcgggaccggaaggggacgtacggacggtaggacgtaacgtacgtaaacgtacgtggtcgtacgtacgacctaaccgtacttacgttcgttaccttcttaccgttcccgtacccgacttactcgtacgaccgtacgccggacggtacgtcgacggacggccggtacgtagggacgagggctacg

SEQ ID NO: 101544 - DNA, 500 bp, Homo sapiens
  misc_feature: GYAE6OF02FY2PC.8.67.G01.1.454.CMB.1.raw
  modified_base (249)..(249): a, c, t, g, unknown or other
  misc_feature (249)..(249): n is a, c, g, or t
  modified_base (342)..(342): a, c, t, g, unknown or other
  misc_feature (342)..(342): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (497)..(497): a, c, t, g, unknown or other
  misc_feature (497)..(497): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagaaagagtcaccatcacttgccgggcaagtcagaccattagcacctttttaaatggtatcaacagagcccaggaaaagcccccaaaactcctgatttanggtgcatccattcgcaaagtgggtcccatcaaggttcagtgcagtggatcgtgggcagatttcacctcaccatcagcagtctgcaacctgaanctttgactaacttactactgtcagcagtcttacagtaggccggcacctttggccagggacgaagcgtggagatacgaacgaactgnggcngcacatctgtcttcattcctccgctactctagacgacacgcgagctagcgcggctcggacaggcngta

SEQ ID NO: 101545 - DNA, 1038 bp, Homo sapiens
  misc_feature: GYAE6OF02JCUYB.8.67.G01.1.454.CMB.1.raw
tcagctcgcgtgtccacgaccggtgctcgatttagagtatacatattggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtattcaacagacgtcccaggaaaacgtccccccaaaactccctaggtaacttttagtgggttacgactactacctagttttccgacgaaaagggttcgggggtacccctaagtacgtaaacgggtttcctaaggttcgggtccgaaaggttgggtaacttccggtttacgggggggcctaacgggttaacttttcccgtaaaccccccttcccggaaaccctaacgttacccggaaacggtccgtaaacgggttcccttaccgggtaccctaaaccccggttagggtaaaacggtccttttttaacgggaccttaaaaaccggttttaacctttaacccgttaggttaacccgtaagggtaccccggtttaaagggtttacccttttaaaccggaaacggggtttaaccgggtacccccgggggggtaattaacccccgggtttttacggggggaaccccggttaaacggggggggtaaaacccggtaaacggggttacccgtttaaaccggggggaacggttaaaccgtttaacccgggggtaaaaacccggtttaaaaccggttcggggtttaaccggggaacccgtttcgggtaacccctaaacccggttaacgtttcccggtttttaccgttaacccgttttaaccgttaacccggttttccccttttacccccgggtaaccccttaaaccgtttccgttaacgggtaaccggttaacccggttaaacccgggtacccggtaaaccggtacccggttaccggggttacgggtacccggggggtacctttacccgggggaaccggtaaacccggggtcccggtaaacgg

SEQ ID NO: 101546 - DNA, 739 bp, Homo sapiens
  misc_feature: GYAE6OF02IQ92A.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagccaaggaaaacgccccaaaactcctgattttagtggtgacctatacctatttacgaccgaaaaggttcggggtaccccagtacgtaaaggttcaaggtggacaggtcggatcggtgggcagtactttccaccctcaccatcagcaggtctcgactaacctgaaaggtctttacgactaaacttacgtaactcgtacgacggtactagttacttaacaggttacgggcccgggtacgttaacccggtttcgggaaccggagggggtaaaccgtaacgggacggttacggggaaacggtaacgtaaaccgggtaaacccggaaacggtttcgggtacggtccggtaacgtcccgaaacccgtaagttcccgttacggtttaacccgtttcgaaccgttttccctaaccccgtaagtaccccgtacgttaccgtacgggtaaaccggtaacctaccgggaaccgtaaggtccgttagggaccgggttacccgggacggtttacgggacccggtaacgggtccgg

SEQ ID NO: 101547 - DNA, 568 bp, Homo sapiens
  misc_feature: GYAE6OF02HKQIC.8.67.G01.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagactaccttttaaatggtatcaacagacgcccaagggaaaacgcccccaaactcctagtatttanggtncatccatttcgacaaggtcggggtccatcaggttcagtggcagtggatcgtggggcagtactttccaccctcaccatcacgcagtctcgacctaacctgaacgtactttagactaacttactactgtacagctagttcttacgaggtacgggccggtactaccgtttggaccgaaggggacgagtgtaggagacgtacgaacgtagtgtcggtactgaccaccgtagtctcgttctacctactccgtcccgctacttcgagtacgacgaccgcgagacgtgacgggtcggcgtcggacgtacggctacg

SEQ ID NO: 101548 - DNA, 598 bp, Homo sapiens
  misc_feature: GYAE6OF02HCT8N.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaaactccctgattttatggtgcatccatttcgcaaagtcgggtcccatcaaggttcagtggcagtggatcgtgggcagtatttccaccctcaccatcagcagtctgcaacctgaagtctttgactaacttactactcgtcagctagttcttacgagtacggccggctaccgtttggaccgaaggggacgaagtcgtagggaagactacgaacgtaacgtggtaggctgaccgaccagttccgttcggttacctttccgtaacgttcccgttcccgacctacttccgtacgaacggtacccgaacggtcggtacgtcgtaggacggtccggggtcgtaccggggactacgggccgtaacgg

SEQ ID NO: 101549 - DNA, 601 bp, Homo sapiens
  misc_feature: GYAE6OF02H8CU8.8.67.G01.1.454.CMB.1.raw
  modified_base (259)..(259): a, c, t, g, unknown or other
  misc_feature (259)..(259): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagccaccatcacttgccgggcaagtcagaccattagctaacctttttaaattggtatcaaacagacgcccaaggaaaacgcccccaaaactcctagtattttanggtgcatccatttcgacaaaggtggggtcccatcaaggttcagtggcagtggatcgtggggcaggatttccaccctcaccatcagcagtctgcaacctgaagtactttgactaacttactactgtcacgcagtttccttacgtaggtacgggtcccgggacttaccgtttacgggcccgtaagggggacgaaggtcgtagggaacgagtaacggaaacgacgttggtcggtctcgacaccattcctcgttccttactaccttccgttacccgcctacttccgtcgaacggtcaaccggtcgaacgtccgaggtcggacgggtcgtcggacgtacgggctacg

SEQ ID NO: 101550 - DNA, 561 bp, Homo sapiens
  misc_feature: GYAE6OF02F2U77.8.67.G01.1.454.CMB.1.raw
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
  modified_base (510)..(510): a, c, t, g, unknown or other
  misc_feature (510)..(510): n is a, c, g, or t
  modified_base (545)..(545): a, c, t, g, unknown or other
  misc_feature (545)..(545): n is a, c, g, or t
  modified_base (556)..(556): a, c, t, g, unknown or other
  misc_feature (556)..(556): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaactcctgatttatggtncatcctatttcgctaaaggtcgggtcccatcaaggttcagtggcagtggatgtggggcagtatttccaccctnaccatcgagcagtctgacaactgaatacttgactaacgttacactgtacagctagtctagtacggtacggccgggtctaccgtttcggaccgtaggggacgaacggcgtaggagtagtacgaaacgacgtggtacgctcgaccacagttcgtcgtcttcacttccttcccgacctagtccngtacgacaccgacgacgtcgtggcggtcgggtcgnggacgtacggngtacg

SEQ ID NO: 101551 - DNA, 670 bp, Homo sapiens
  misc_feature: GYAE6OF02JB0YM.8.67.G01.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (319)..(319): a, c, t, g, unknown or other
  misc_feature (319)..(319): n is a, c, g, or t
tcagctcgcgtgtccacgaccggtgctcgatttagagtatacatattgggtttgggggcttttcctgggctcctgctactctggctccgaggtgccagatgtgacatccagatgacccaggtctccatcctccctgtctgcttctataggagacagagtcaccatcacttgccgggcaagtcagaccattagcacctttttaaatggtatcaacgagagcccaggaaaagcccccaaaatcctagatttanggtncatccattcgcaaagtgggtccatcaagttcagtgcagtggatcgtgggcagatttacaccctnaccatcagcagtctgcaacctgaacgtactttgactaacctttactaacgtcgtacctaagtctaacgtttctttaacgacgggttaacgggcccggggtaccgtaacccgttttacgggacccgtaaaggggggtaaccgtaaaggtaccgtagggtaacgtaacgttaccgggaaaccgtaaaccgtgttacggcctacggtcctaacccgtattccgttacggttaccgtttacgtaccttacccgttaccccggtaccctagttcctacggtaacggtacccgtaaccggaccggaacggccgttaggacggtccgggtaccgtagggaccgaacgggtccgaccgg

SEQ ID NO: 101552 - DNA, 616 bp, Homo sapiens
  misc_feature: GYAE6OF02IU1UQ.8.67.G01.1.454.CMB.1.raw
  modified_base (229)..(229): a, c, t, g, unknown or other
  misc_feature (229)..(229): n is a, c, g, or t
  modified_base (326)..(326): a, c, t, g, unknown or other
  misc_feature (326)..(326): n is a, c, g, or t
  modified_base (475)..(475): a, c, t, g, unknown or other
  misc_feature (475)..(475): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctcctgtctgcttctataggagacagagtcaccatcatttgccgggcaagtcagacattagctacctttttaaatggtatcaacagagcccaaggaaaacncccccaaaactcctagtattttagtggtgcaactcctaattttcggaccaaaaggtcggggtcccatactaaaggttcaagtggacagtggatccgnggggtacaggtactttccaccctcaccagtcacgctagtctagacaacgtagaagtactttcgactaaacttctacgtgtcagtctagtacttacgagtacggccggctacgttcggacgagggacgagcgtagagatacgaagtacgngtggctacgccaccattccgtcgttccttacgtacttccctttccccggaccttacgtcgtacggtaacgtaacccgaacggtcccggaagtccgtaggtaccgggcgggtaccggttacgggaacccgagggcccgtaag

SEQ ID NO: 101553 - DNA, 512 bp, Homo sapiens
  misc_feature: GYAE6OF02FFQIX.8.67.G01.1.454.CMB.1.raw
  modified_base (248)..(248): a, c, t, g, unknown or other
  misc_feature (248)..(248): n is a, c, g, or t
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaatcctgatttanggtgcatccatttcgcaaaggtgggtcccatcaaggttcagtggcagtggatctgggcagatttcacctcaccatcagcagtctgcaacctgaagtactttgactaacttacactgtacagctagtctacaggtcggccgggcaccgtttggaccgaggggacgaagcgtggagtatacgaacgtacgtgtcgctgcaccatctgtcttcnctcctccgctntcgngacgacncggcagctggacgcggctcggacgaggcgac

SEQ ID NO: 101554 - DNA, 672 bp, Homo sapiens
  misc_feature: GYAE6OF02HX54T.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttggccgggcaagtcagaccattagcttacctttttaaatggtatacaacagacgacccaaggaaacgcccccaaactcctagtatttagtggtgctatcctatttcgacaaggtcgggtaccatacgtaaggttacgagtggcgaggtaggagtcggtggggacgtagtactttcctacccctacaccacgggggtacacgacagtctacgaccacctagtacgtacttacgtactaacttactactgtacacgtactacgttacttacgtaggtacgggccgggtaccgttaccgtttcgggaccggacggggacgaacggtcggtaggaggtacgtacggaacgtacgttaggtcggcgtacgacctaccgtacgttcgttcgttccgttacttacgttcccgttaccccgtaccgtacgttaccgtacggtacggtaaccgaccggaccgtacggtccgtacggacgggtcgggtaccggtacgggacggtacggcgtacg

SEQ ID NO: 101555 - DNA, 668 bp, Homo sapiens
  misc_feature: GYAE6OF02JNI9T.8.67.G01.1.454.CMB.1.raw
  modified_base (180)..(180): a, c, t, g, unknown or other
  misc_feature (180)..(180): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
tcagctcgcgtgtccacgaccggtgctcgatttagagtatacatattggtttgggggcgttttcctgggtcgttcctgcttactctggctccgaggtgccagatgtgacatccagatgacccagtctccatcctccctgtctgcttctataggagacagagtcaccatcacttgccgganaagtcagaccattagctaacctttttaaatggtaattcaaacagacgacccaaggaaaaccncccccaaaactcctagtactttagtggtanactaatacctacttcgacaaaggtcggtaccagtcgtaaggtactaggtcggacgtaggtaggtatacggtgggactagtacgtttaccgacccgtcaaccatacgagtacacgtcacgaccgtaaccgtanaacgtacgtttanactaacttatctagtaccagactacgttacttagtacggtaacgtcggtacttaaccggttccggtaccgtaagggaacgtacggtacgtaggaacgtacgtaaccgaacggtacgtaggtacggacgtacgaccgtaccgtacgtcgttacgtaccgttacctacgttcccgtacccgacgtactcgtacgtaaccgcggtaaccgtcggacgtccgtagccgggtacggtcgacggcggtacggcgaag

SEQ ID NO: 101556 - DNA, 549 bp, Homo sapiens
  misc_feature: GYAE6OF02GHEAV.8.67.G01.1.454.CMB.1.raw
  modified_base (256)..(256): a, c, t, g, unknown or other
  misc_feature (256)..(256): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagaaagagtcaccatcacttgccgggcaagtcagaccattagctacctttttaaatggtatcaacagagcccaaggaaaacgcccccaaaactcctgatttatggtncatccatttcgcaaagtgggtcccatcaaggttcagtggcagtgatcgtggggcagtatttcacctcaccatcagcagtctgcaactgaacgtctttgactaacttactactgtcagctagtcttacgagtacggccggtctaccgtttcggccgagggacgaggctaggagagtacgaacgtacgtggtgcgtgccacagttctcgttcttctacttccttcccgactactcgtacgacgacgtacgcgtacgcgtcggacggtccgggcgtacggcgaacggcgacgtacg

SEQ ID NO: 101557 - DNA, 560 bp, Homo sapiens
  misc_feature: GYAE6OF02HKNQV.8.67.G01.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (487)..(487): a, c, t, g, unknown or other
  misc_feature (487)..(487): n is a, c, g, or t
  modified_base (547)..(547): a, c, t, g, unknown or other
  misc_feature (547)..(547): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtgcatcctatttcgacaaagtggggtcccatcaaggttcagtggcagtggatcgtggggcagactttccaccctcaccatcagcagtctacgactaaccgtgaacgtactttgactaaacgtttactacgttgtacacgtctagtttcttaagacggtacggtcccgggactaccgtttcgggaccgaggggacgaacgcgtggaagtacgtacgaacgactggtcgctgcaccntcgtgtaccttctactctcccgctatctagacgacacgacgagcgtaggacggcggtcgnggacgaggctacg

SEQ ID NO: 101558 - DNA, 513 bp, Homo sapiens
  misc_feature: GYAE6OF02H1KG0.8.67.G01.1.454.CMB.1.raw
  modified_base (392)..(392): a, c, t, g, unknown or other
  misc_feature (392)..(392): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaatcctagtattttatggtgcatccatttcgacaaaggtgggtacccatcaaggttcagtgcagtggatcgtggggcagtactttcaccctcaccatcagcagtctgacaacctagaacgtacttgactaacttactactgtcagcagttctanagtgcgtctacgttgcgagggacgagtcgagagatacgaacacgtgngctagccacnctctcgtcttacnctcgtccgctatctgacgacncgngcgcgtgagtcggncggcacgcgtacg

SEQ ID NO: 101559 - DNA, 734 bp, Homo sapiens
  misc_feature: GYAE6OF02H36PD.8.67.G01.1.454.CMB.1.raw
  modified_base (360)..(360): a, c, t, g, unknown or other
  misc_feature (360)..(360): n is a, c, g, or t
  modified_base (711)..(711): a, c, t, g, unknown or other
  misc_feature (711)..(711): n is a, c, g, or t
  modified_base (720)..(720): a, c, t, g, unknown or other
  misc_feature (720)..(720): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtccaccatcacttggccgggcaagtcagaccattagctaacctttttaaatggtaactcaacagacgacccaaggaaaacctccccaaaactcctagtattttatgggtcgcaacttccgtagtttccggaccgtaaaagggttcggggttaccccaagttacgtaaacggtttcgaaggtcggacgaaggttggacttcggnggggctaaggtctttacccaccctcaaccagtccgacgcacgttctgacctaacgtaggtaaacgtctttacacttaaacttaccgtatcggtacacgaccttaagtttaccgttaacggaacggtacggggtcccggtccgttaaccggtttcgggaccggtaacggggggtaacggaacgtccgggttagggaaacgtacggttaacggaaaccgttaacgttgggtacgcgttacgacccgtaaactcgttcgttacggttctttccgaaccgttccgtttccccgacgttaactccggtacggtacgaaccgtaaccgggcgtcgtacggttcgggacggccgggtntaccggggntaccggggcctagg

SEQ ID NO: 101560 - DNA, 782 bp, Homo sapiens
  misc_feature: GYAE6OF02GUWBG.8.67.G01.1.454.CMB.1.raw
  modified_base (708)..(708): a, c, t, g, unknown or other
  misc_feature (708)..(708): n is a, c, g, or t
tcagctcgcgtgtccacgaccggtgctcgatttagagtatacatattgggtttgggggcttttcctgggctcctgctactctggctccgaggtgccagatgtgacatccagatgacccagtcctccatcctccctgtctgcttctagtaggagacagagtccaccatcacttcgccgggacaagtcacgacctagttagaccttaaccgtttttaaatggtaactacaactagacgaccccgaaagggaaaccaccccccaaaactccttagtaacttttagacggtacacgtaacttcctaagtttccgacgtaaacggtcggggtacccctaagtacgtaaggttcacggtggacctagggttcggtaacgtcggttaggggactaacggttaacctttccccgaacccctccgtaccctagtaccgaacgtcgaacgttccgtacaccgtaaaccgtacgtaacgttacctttacggaaccttaaccgtttaaccgtaccgttacgtactaaccggtcgtaaacgtttcccgttaacgtaacgggttaccgggtcccgggtaccgttacccggtttccgggaccggtaacggggtaccgtaacggtcggtaggaacgtacgtacgggaacgtacggtggacggtcgtacggcgtacgacgttccgttacgttaccgttcgtaccgttcccgtaccgtcaccgttntaccggacgtacggaccgtaccgtacgacgtccgggacggtcgggtaccgacgggtcccgtacggccgtaacgg

SEQ ID NO: 101561 - DNA, 519 bp, Homo sapiens
  misc_feature: GYAE6OF02FLNPS.8.67.G01.1.454.CMB.1.raw
  modified_base (266)..(266): a, c, t, g, unknown or other
  misc_feature (266)..(266): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagccccccaaactcctgatttatggtgcatccatttcgnaaagtgggtcccatcaaggttcagtggcagtggatctggggcagactttcaccctcaccatcagcagtctgcaacctgaagtctttgactaacttactactgtcagctagtcttacaggtacggccggctaccgtttgggccgtaggggacgaagcgtaggagatcgaacgacgtgtgctgcaccatctgtcttcacttccttcccgcatctgacgtacgacgcgagtcgtgacggcggcgtgggcaggcacg

SEQ ID NO: 101562 - DNA, 633 bp, Homo sapiens
  misc_feature: GYAE6OF02GQQ52.8.67.G01.1.454.CMB.1.raw
  modified_base (347)..(347): a, c, t, g, unknown or other
  misc_feature (347)..(347): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgtattttatgggtgcatccatttcgacaaaggtcggggtacccatcaaggttcaggtggcaggtggatcgtggggcagtattccacctcaccatcagcagtcngaccaactagaatacttgactaactttacacgtcgtacacgtcagttctagaggtacggccgggtactaccggtttcggaccgaaggggacgaaggtcgtaggacgtacgtacggaaacgtaacgtcggtcggtcgtcgaccgtaaccgtacttccgttacgttacctttaccgtactttccccgttaccccgacccttagttccgtaggtaaccgaaccggtaccggaccgtacggtacgtagggacgggccggggtaccgtcgggaaccgtacgggccgtaacg

SEQ ID NO: 101563 - DNA, 624 bp, Homo sapiens
  misc_feature: GYAE6OF02IS5PY.8.67.G01.1.454.CMB.1.raw
  modified_base (255)..(255): a, c, t, g, unknown or other
  misc_feature (255)..(255): n is a, c, g, or t
  modified_base (387)..(387): a, c, t, g, unknown or other
  misc_feature (387)..(387): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgccaaggaaacgcccccaaaacttcctagtattttanggtgacactcctatttcgacaaaggtcggggtaccccagtacaaggttcaggtggactaggtggattcggtgggggctaggtactttccacccctcaacctatcagctagtctgaccaactagaagtacttnacgtaaacttcgtatcgcagctagttcttacacggtacgggccggtctaccgtttcgggccgtaaggggacgtagtcgtagggagaacgtacgaacgtaacgtggtacggtcgtcgaccgtaactcgtcgttacgtcctttacgttaccgtccgttacccgacgttactcgtggacgacctaaccggcggacgtacggtaggcggtcgggaccggtcgggaacggtacggccgtacg

SEQ ID NO: 101564 - DNA, 567 bp, Homo sapiens
  misc_feature: GYAE6OF02FWHIH.8.67.G01.1.454.CMB.1.raw
  modified_base (355)..(355): a, c, t, g, unknown or other
  misc_feature (355)..(355): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgcccaagggaaaaacgccccccaaaactccctagtattttatgggtgcatccatttccgactaaaaggtcggggtaccccatctaaggttcagtggcagtggatcgtggggcagtattcacctcacatcagcagtcngacaactgaatctttgactaacttactactgtcagctagttcttacaggtaggccggtctacgtttggccgtaggggacagcgtggagacgtcgaacgacgtggtacgctgaccactatcgttgtccttactactcccttcccgactacgtcgacgtacggaccacggacgacgtcgtacggacggcgggacgtacgggacgagggctacgg

SEQ ID NO: 101565 - DNA, 640 bp, Homo sapiens
  misc_feature: GYAE6OF02H4RKC.8.67.G01.1.454.CMB.1.raw
  modified_base (177)..(177): a, c, t, g, unknown or other
  misc_feature (177)..(177): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgctttctataggagacagagtcaccatcacttgccgggnaagtcagaccattagctactttttaaatggtatcaacagacgcccaaggaaaacgcccccaaactcctagattttanggtgcatcctatttcgactaaaggtcggggtacccagtcaaggtttcagttggcagtggatcgtggggnagtactttccaccctcacctatcagcagtctgcaacctagaagtactttcgactaacttactacttgtcagcacttcttacagtaccgggccggtacctaccgtttgggccgaagggggtacgaaggcgttagggaacgacgttaccggaaaacggtaccttggtcggtacgtgaccgtacctacgttcgttcgttacctttcgtaacctttcccgttaccccgacttaacgtttcccgtacggtaacgacccgtaccgaccggtacgtaccgttaggacgggtccggggtacgtcgggaccgtacgggcgtaacgg

SEQ ID NO: 101566 - DNA, 895 bp, Homo sapiens
  misc_feature: GYAE6OF02JVPGX.8.67.G01.1.454.CMB.1.raw
  modified_base (234)..(234): a, c, t, g, unknown or other
  misc_feature (234)..(234): n is a, c, g, or t
  modified_base (671)..(671): a, c, t, g, unknown or other
  misc_feature (671)..(671): n is a, c, g, or t
tcagctcgcgtgtccacgaccggtgctcgatttagagtatacatattggtttgggggcttttcctgggctcctgctactctggctccgaggtgccagatgtgacatccagatgacccagtctccatcctccctgtctgcttctataggagacagagtcaccatccacgttgccgggtacaaggtcacgaccagttagcctaaccttttttaaatcggtaactcaaacaggtacnccctaagggaaaaaccgtccccccaaaaacgttcccctaggtaactttttaacggcggggttactacctaacgttccctagttttaccgaaccggtaaaacggttcgggggttaccccaagttacgtaacggtttacacgggttggaccgtaaggtcgggtacttacggtacggggtacaggttaccgtttaccgaaccctttccggaaccctattaccgacggactacgttacctacggaccctaaccgttacggtaaacttaccgttttgaacccttaaaccgttactacccgtagtacctacgggacttacggtacctttaccgtaacggtacgggtaccggaccttacccggttcgggaaccgggtacggggtaaaccgggtacgtaccgggtacgggtacggtaaaccgttaccgggaaacgggttaaccgnggggttaccgggtaccgttaaggtaccccggtaaccttaacgggttttccccggttaacgtttaccgtttacccgaacccgttttccccgttacccgttaaccggttacttacccggtacggttaaaccggccccggttaaacgggtcccgtaaggttcccggaacggtacgggggtacccgggttccggtaacgggtacccggtaacccgggtcgaacccggg

SEQ ID NO: 101567 - DNA, 610 bp, Homo sapiens
  misc_feature: GYAE6OF02GHUVY.8.67.G01.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagctcgcgtgtccacgaccggtgctcgatttagagtatacatattggggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtnacatccatttcgcaaagtgggtcccatcgaaggttcagtggcaggtggatcgtgggcagtactttccgacctcacctattgctagtctgacctaacctgaacgtactttgactaacttctactgtcagcagttctagagtacggccggtactaccgtttggaccggaggggacgaaggcgtaggacgacgtacggaacgtacgtggtacggtcgtcgaccgtacctacgttcgttacggttccttacgttacgttcccgttacccgtacctacgtacgtacgaccgtaccgacggtaccgtagtccgtacgggacgggtcgggtacgtaccggacggacgggtaccgacgtaacg

SEQ ID NO: 101568 - DNA, 947 bp, Homo sapiens
  misc_feature: GYAE6OF02IHAPQ.8.67.G01.1.454.CMB.1.raw
  modified_base (236)..(236): a, c, t, g, unknown or other
  misc_feature (236)..(236): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctcctgtctgcttctataggagacagagtcaccatcacttggccggcaagtcacgacattacgcttaacctttttaaatggtatacaacagacgacccaaggaaaccncccccaaaactcctagtattttacgtgggtcgactattccctaagttttccgaacgtaaaagggttccggggtaccccaagttaccgtaaagggtttccgaagggtttgggacccgtaagggttacgggtaacgtttcgggtacgggggggtactaacgggtttaactttttaccccgtaccccccgttacccgaaccccttaagtttacccgaacggtaacccgtaacggtttccgaccgggtaaaccctaaaccccggtttaaggaaaccggtttaacttttaccggaacctttaaaacccggttttaaccttaacggtttacgtaccgtaacggttcccgttaaacggttttaccctttaaaccggtaaggggttaccggggtacccccggggtttaaccgttaaccccgggtttttaccgggggaacccggggtaaacgggggggtaaacccgggtaacggttccggggttaagggtaaaccggtaacccgggttaaaccggaaaccgggtttaacccgttcggggtacggtccggtaccggtaaccgtaaccgttacgtttaccgttccggtttacctttaccttaaccgtttccccttacccggacctttacgtccgttaaccgacggtaccgaaccggtccggtaacgtaccggttcgggacccgggtcgggtacccggtacgggaccggacggtcggtacccg

SEQ ID NO: 101569 - DNA, 601 bp, Homo sapiens
  misc_feature: GYAE6OF02IV8P1.8.67.G01.1.454.CMB.1.raw
  modified_base (257)..(257): a, c, t, g, unknown or other
  misc_feature (257)..(257): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (501)..(501): a, c, t, g, unknown or other
  misc_feature (501)..(501): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccgaaggaaaacgccccccaaaactcctagattttagnggtgcatcctatttcgcaaaggtcgggtccccatctaaggttcagtggctaggtggagttcgtggggcagtactttcgaccctcactatcagcagtcngacctaacngaacgtctttgacctaactttactactgtacacgtctaagtttcctacgtacggtacgggcccggtacctaccgtttagggacccggtaaggggacgaacggtcgtaggagtactacggtaacgtacgtgtcggtcngtccgaactgtcgtcgttccttcctacgttccctcccgtactactcgtaggacgtaccgaccgcggacgtcgtaggacggcggcgtcggaccgaggcacg

SEQ ID NO: 101570 - DNA, 557 bp, Homo sapiens
  misc_feature: GYAE6OF02GA9KJ.8.67.G01.1.454.CMB.1.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaactcctagatttatggtncatcattcgnaagtggtccatcaggttcagtggcagtggatcgtgggcagactttcacctcaccatcagcagtcngacaacctagaacgtactttgactaaactttactactgtcacgactagtacttacgagtacggccgggtactaccgtttcggaccgaggggacgaggcgtaggacgtacgtacggaacgtaacgtgtcgtcgtacgacaccacgtactgttacttactacttccttcccgcctatctacgacgacacggcgacgtcgtggacggcggcgtcggacgacggcgacg

SEQ ID NO: 101571 - DNA, 604 bp, Homo sapiens
  misc_feature: GYAE6OF02FYSEM.8.67.G01.1.454.CMB.1.raw
  modified_base (256)..(256): a, c, t, g, unknown or other
  misc_feature (256)..(256): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaagggaaaacgcccccaaaactcctgatttatggtncatccatttcgcaaagtggggtcccatcaaggttcagtggcagtggatcgtggggcaggtatttcaccctcaccatcagcagtctgcaacctgaagtactttgactaaactttactactgtacagctacgtacttacgagttacgggccgggtctaccgtttggccgaaggggaccgaaggcctagggacgacgtacggaacgaacgtggtacggcgtgaccacctactcgttggttctttcgaacttccgttacccgacctacgttccgtacggtaacgaaccgaccggaccggtacgtccgttagggtacgggtccgggtccgtgggaccgaacgggcggtaaccg

SEQ ID NO: 101572 - DNA, 812 bp, Homo sapiens
  misc_feature: GYAE6OF02I83MO.8.67.G01.1.454.CMB.1.raw
  modified_base (795)..(795): a, c, t, g, unknown or other
  misc_feature (795)..(795): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggacaagtcagaccattacgctaacctttttaaatcggtatcgaacagacgaccccgaaggaaaaccgccccccaaaacttcccttaggtaacttttagtgggtacgtacctaactcctaacgttttaccggaaccgtaaaaagggttccggggggttaccccctaaagtttaccggtaaacgggttttaccgaaaggggttacgggccgtaaacgggtttgggggaacgtttacgggttcgggggggacctaaacgggttaaacgttttttccccgaaccccgtttaaccaacccggtacctttaccgaacgggtaccctaaacggttccgttacgaacccgtaaacccgttaagaacggttacttttacgaaccttaaacgtttaaccgttactacgttacgaacgtacgttacgttacttaacgaacgggttaccgggaccggtaaccgttacccgtttacgggaccgggtaacggggtacgtaacggcgttacgggaacgtaacgtaccggaaacggtacgtggtacggtacgtcgacgtaactgtacctcgttcttacgtctccgtacccgctacgttcaggtacctaacgcgcgtacgcgtagacggcggtaccgnggtaccgaggccgtaag

SEQ ID NO: 101573 - DNA, 503 bp, Homo sapiens
  misc_feature: GYAE6OF02F1GU0.8.67.G01.1.454.CMB.1.raw
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
  modified_base (378)..(378): a, c, t, g, unknown or other
  misc_feature (378)..(378): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaaactcctgatttanggtgcatccatttcgcaaagtggggtcccatcaaggttcagtggcagtggatctggggcagatttcacctnaccatcagcagtctgcaacctgaagactttgcaacttactatgtcagcagtcttanagtaggccgggcacctttggcctaggggacgaagctggagagtcgaacgaactgtgctgcacatctgtcttcatccttccgctatctgacgacacgcgagctgacggcgggctgggcaaggcacg

SEQ ID NO: 101574 - DNA, 630 bp, Homo sapiens
  misc_feature: GYAE6OF02I1AC5.8.67.G01.1.454.CMB.1.raw
  modified_base (371)..(371): a, c, t, g, unknown or other
  misc_feature (371)..(371): n is a, c, g, or t
  modified_base (545)..(545): a, c, t, g, unknown or other
  misc_feature (545)..(545): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccactcctccctgtctgcttctataggagacagagtccaccatcattgctgggcaagtcagacctattacgcttaactttttaatcggtatcaacagacgaccaaggaaaacgaccccctaactccgtagtaatttacgtggtactactactaccgtatttcgacgtaaaggtcgggacctactagtaagtcgagtgtacgagtgatcggtggcagtacttccgcctacacgatcacgcgtacgttcncgtacacgtagaacttcttacgacttaacttacacttgacactcgtactctaacgtcggtacggtccgtacgtaccgttaggacgtacgggaaacgttacggacgtaggtaacgacgttaacggacgtaacgtgtcgacgttaccgaaccacgtactcgtcgttacttaccgtntacccgttccataccgtagtaccgaagacccgtaggaccctagtacgggccggtacggtcccgtaacgggtccgacggacgtacg

SEQ ID NO: 101575 - DNA, 567 bp, Homo sapiens
  misc_feature: GYAE6OF02FQ3DE.8.67.G01.1.454.CMB.1.raw
  modified_base (279)..(279): a, c, t, g, unknown or other
  misc_feature (279)..(279): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
tcagctcgcgtgtccacgaccggtgctcgatttagagtatacatattgggtttgggggcttttcctgggctcctgctactctggctccgaggtgccagatgtgacatccagatgaccccagtctccatcctccctgtctgcttctataggagacagagtcaccatcacttgccgggcaagtcagaccattagctacctttttaaattggtatcaacagagccccaaggaaaagccccccaaaactccctgtatttatggtgcatccatttcgctaaagnggggtcccatcaaggtttcagtggcagtggatcgtgggcagtatttcaccctcaccatcagcagtctgcaaccgtgaactactttcgctaaacttactactgtcagcagtcttagacgtaggccggctaccgtttggaccgaggggacaggcgtaggganagtcgaacgacgttggngtcgtacgccactatcgttagtccttactacgttccttcccgctactacgtcgtacgacgtaaccgccgtagtccgtaggacggtcggtccgtcgggacctaggccgtacg

SEQ ID NO: 101576 - DNA, 1066 bp, Homo sapiens
  misc_feature: GYAE6OF02GFR9R.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtcctccatcctccctgtctgcttctataggagacagacgtcaaccatcacttggccgggcaaagtcaacgacctaagtttacgaccttaaccttttttaaagttaggtaacttaccgaaaacaacggtaacggaccccgaaaaggggaaaaacccgtaccccccctaaaaacgttccgttaacgtaaagtttttaacggtaggggttacaccgtaacttaccccgttaagttttacccggaaaacgttaaaaacgggggttccgggggttaaccccctaagttaaccggtaaaaacgggttttccggaaaggtttacgggaccgtaggttaacggggtaacgttcgggtagggggtacctaaacgggtttctttaacccctaaaccccggtttccaaccgtaagtttaaccgacggtaaccgttaacggtcccgttacggaaaccccgttaaaccggttaggtaaaccgtttaccgtttaacggaaacttaaaacccgggttttttaccaaacggtttaggtaacccggtaaagtacccggtttaacggttttaacccgttaaaggttaccggggttaaaccgggggtcccgggtaaaccccgtttaacccgggttttacccggggaacccggggtaaaaggggggaaccttacggggacgggttaacgggttaaccgggaaaccggttaaacccggtaaaacggttacggttaaaccggttaggggtacccgttaaggtaaccccggtaaccgtaacgttttccccgttaaagtttccccgttttaaccgacccgttttaaaccccgttcccccgggtaacttacccgttttaacggaaccgggtaacccggtaaacccggtaacggtaacccggtaaccgttcggtaagggtcccgggtaccgggggtaacgttaccgggaacccggggtacggtacggtaacg

SEQ ID NO: 101577 - DNA, 788 bp, Homo sapiens
  misc_feature: GYAE6OF02F5Y8I.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacttttaatggtatcaacagacgcccaaggaaaacgcccccaaactcctgtatttatggtgcactcctatttcgacgtaaaggtcggggtacccctagtacgtaacggttacaggttacggacgtaggttacggacgttcggtacgggggacctaacggttactttacccgaacccccttaccgtaaacccgtattacccgaggtacctacggttccgtaccggtaacctaaccgtaacggtaaacgttaccgtttacgtaaccgtaaacctttacgttaactcgtaccgaacgtacctaaccgtttacgtttaaacgtacgggtccgggtacccggtaaccgtttaccggtttacggggaccggtaacgggggaaccgtaacggtaccgtagggaacgtacggtaaccgggaaccgtaacggtagggtccggtacgtacggtaccaaccgttcgttacgtttaccgttctttacctaaccgtttcccccgtttacccgaccttacgtaccgtacggtaacccgtaacgaaccggtaccggtacgacgttacggacgggttccgggacggttacggacggtacgaccggtaacg

SEQ ID NO: 101578 - DNA, 591 bp, Homo sapiens
  misc_feature: GYAE6OF02FKMZ7.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaaactcctgtattttagtggtgcatcctatttcgacaaaggtcggggtcccatcaaggttcagtggcaggtggatcgtggggcagtatttccaccctcaccatcagctagtctcgcaacctgaagtactttcgactaactttactactgtacagtactagttacttacgaggtacggtccgggaccgttaccgttcggaccggacggggaacgacgcgtggaagacgtacgaacgtacgtgtcggcgtcgccaccgatcgttcgtcttactcttccctccgacctagtccgtacgacgacgaccggacgtacgtcgtagggacggtccggggacgtacggacgacggcgtacg

SEQ ID NO: 101579 - DNA, 626 bp, Homo sapiens
  misc_feature: GYAE6OF02FQCZV.8.67.G01.1.454.CMB.1.raw
  modified_base (224)..(224): a, c, t, g, unknown or other
  misc_feature (224)..(224): n is a, c, g, or t
  modified_base (399)..(399): a, c, t, g, unknown or other
  misc_feature (399)..(399): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttcataggagacagagtcaccatcacttggccggcaagtcagagcattggcacctacttaattggtatcagcagaacaggaacnccccaaatcctgactcaattatgcatcctagtttcgactaaacggtgggtaccccagtacaagtaacttcaggtggcggtggatcgtgggacagtctttacacttctacaccatacaacgagttctgacagtattaggacggtattactgactaaactttacgttaactgtacgngtacgaggttacgtcccgaccggaccccgcttacgtaccgggttccggggaccgggggttaacctaaacgggcggtaaccgtaccgaaacgtactacgggtacgccgtcgaccgtacctacgttcgttcgttcttctacttccctcccgtacacgtaccgtaggaccgtaccgccggtacgacgcggttacggaaccgggtccgggtcgtaccgggaccgtaacggg

SEQ ID NO: 101580 - DNA, 918 bp, Homo sapiens
  misc_feature: GYAE6OF02HV6X9.8.67.G01.1.454.CMB.1.raw
  modified_base (178)..(178): a, c, t, g, unknown or other
  misc_feature (178)..(178): n is a, c, g, or t
tcagctcgcgtgtccacgaccggtgctcgatttagagtatacatattgggtttgggggcttttcctgggctcctgctactctggctccgaggtgccagatgtgacatccagatgaccagtctccatcctcctgtctgcttatataggagacagacgtcaccatctacttggcccgggnaacgtcagacctagttacgcctaacctttttaagtcggtaataccaacgaagaacgtacccgaaacgggaaaaccgaccccccctaaaacttccctaggtaactttttaaggttcggttacggacctaacgtacccgttaacgttttacccggaacggtaaacgggtccgggggttacccctaacgttaaccggtaacggtttaccgaggttacgggacgtacggtgggtaactttccggggtacgggggtacctaaacggttacctttttaccccgaaccccctttacgaaccgtacttacgaacgtacggtacgttaccgtacggaaaccgtaccccggttaggtaaaaccgttccgttttacgaaccgttaaacttaccttacgtacgttaccaggtacctacggtttacctttaacgacgggttaccgggccgggttaaccgttacccgggttcgggaaccgggtaacggggaacgtaacgggtccgggttaacgggaagttaaacccgtaccgggtaaaccgtaaacggttccgggtagtacccggtacgttaaacccctaaccggtacgtttacccgtttgtaccgtttaccgttaacccgttccgtttaaccccggacttaaccgttacggtacggtaaccgtaaccggttaccggggtaactacggtaaccgtttcggggacgggtaccccgggttagtaacccggggacggttacccggaaggttaacccg

SEQ ID NO: 101581 - DNA, 589 bp, Homo sapiens
  misc_feature: GYAE6OF02HE4V5.8.67.G01.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccatttcgcaaagtgggtccatcaagttcagtgcngtgatcgtgggcagatttccacctcaccatcacgcagtctgacaccgtgagtactttgactaacttctactgtcagtctagttcttaacgagtacgggaccggtctaaccgtttggaccgtaaggggacgaacggcgtagggacgattaccggaaaccggtaacgttggtcggtccgtacgacgtaccacgttaccgtcgttacttcactttcccgttcccgacgtctacgtacgacgacaccggacgacgtaccggacgtacgggccgggtaccgtgggacctacgggtacgacgg

SEQ ID NO: 101582 - DNA, 845 bp, Homo sapiens
  misc_feature: GYAE6OF02I6MOJ.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtccacctatctacttcgcccggggacaagtcagaccattacgctaaccctttttaattcggtatacaacagacgacccgaacgggaaaaccgccccccaaaactccctagtaactttacgtgggtacacctactacctacgttttaccgaaccgtaaacgggttaccgggggtacccctaacgttacgtaaacggtttaccgaagggttcgggtccgtaaggttacggggtactacgggtacgggggtactaacggtaccgtttaccccgaaccccttacccgaaccctacgttacccgaggtacccttacgtacgttaccggaaccgtaacccgttaggtaaacgttaccgttttacggtacccttaaaaccgttttaccttaaccgttacgtaccgtacgtacctttaacgttaccgtttaaccggtacgggtaccggggtacccggtaccgttaccggtttccgggaccggtaacggggtaccggaaggtccggttacggtaacggacgtaccggaaacgttaccggtggtacggtaccgtgaacccgtacgttacttccgttacgttccttacctaccgttaccctccccgtagttaccttacgtcgtaaccggaaccgtacggtacggccgtacggtagggacggtacccggacggttacggaccggtacgggtacctaacgg

SEQ ID NO: 101583 - DNA, 783 bp, Homo sapiens
  misc_feature: GYAE6OF02I3Q59.8.67.G01.1.454.CMB.1.raw
  modified_base (218)..(218): a, c, t, g, unknown or other
  misc_feature (218)..(218): n is a, c, g, or t
  modified_base (776)..(776): a, c, t, g, unknown or other
  misc_feature (776)..(776): n is a, c, g, or t
tcagctcgcgtgtccacgaccggtgctcgatttagagtatacatattgggtttgggggctttttcctgggctcctgctactctggctccgaggtgccagatgtgacatccagatgacccagtctccatcctccctgtctgcttctataggagacagagtcacatcacttcgccgggacaagtcagaccattagtctaacctttttaaatgtatacaanagacgaccaacggaaaacgacccctaaatcctagtaatttagtggtgctactaccttagtttcgaacgtaaggttcgggtacccaagtacgtaaggttacgacggttcggacgtaggtaggaacgttccggtggggacctaacgttactttacccgacccctacacctataccgacgtaccgtagtacttcgaacccttaacgaaggtaaacgttacgtttacggaaccttaaaacctttaccgtaacgttcgtaacgaacggtacttaacgtaccgtttaacggacggtaaccggggtcccggtacgtttaaccccggtttacgggaccgggaaacggggtaaccggacggttaaccgggtaggaacgtaaccggtaaacggaaccggtaacggttcgttacggaccgtcgaacctaaccgttacgtcgttacgttacgttacccgttaacgttccccgtttaacccggtataccttggtaaccaacggtacccgtaaccggtacggaccttcggacggggttaaccggccgggttaacgcgggaacggtaccgggntaaccgg

SEQ ID NO: 101584 - DNA, 608 bp, Homo sapiens
  misc_feature: GYAE6OF02FQHLT.8.67.G01.1.454.CMB.1.raw
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (595)..(595): a, c, t, g, unknown or other
  misc_feature (595)..(595): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaaacttcctgaattttanggtncatccaatttccgacgaaagtcggggtcccatcgaaaggttcagtggctagtggatcgaggggcagatttcnccctnaccgatcgagcagtctagacaaccgtgaacgtacttttcgactaaacttacncgttcgtacagtccgtacgtacttagtagtacgggccgggctacgtttcggccgaagggacgaagcgtacggagtataccgaaacgtaacgtcggtaggtcctagcctaacctactcctacgttcctttacgaccgttcccctacccgtcaacgttcgtaagaccgacgacggcgtaacgtcgaggtacgggccggtagacggtanaaccggggctacg

SEQ ID NO: 101585 - DNA, 907 bp, Homo sapiens
  misc_feature: GYAE6OF02JSYOZ.8.67.G01.1.454.CMB.1.raw
tcagctcgcgtgtccacgaccggtgctcgatttagagtatacatattgggtttgggggcttttcctgggctcctgctactctggctcgaggtgccagatgtgacatccagatcgacccagtctccatcctccctgtctgcttactataggagacagagtccacctatcacgttcggaccgggactaacgtcaacgacctagttacgacctttaacgtttttaagtggtactaccgaacacggaaccgacccgaaagggaaaacccgtcccccaaattcccgttagttagttttacgtacgggtctacctaacgttaccttacgtttaccgaacggttaaacgggttccggggtaccctaacgtaaccgttacggttacgtaacgggtcggtacggtacggttaggacgttcgggcgggtacgtaacggttactttaccccgaacccgtttaccaaccgtacgttaaccgacggttaccgtaacgttccgtaacgtacccgttaacggtacggttaaccgtttacgtttaccgaaccttaaacgtttccgtaacgtacgttcgacgttacgtacgttttacgtacggacggttacccggggtacccgtaccggtttacgggtaaccgggtcgggtaaacggggtacccgggtagtaaccgggttaacggtaccggtaccggtaaacggtaacccgggttacggttacggttacggtaccgttaaccggtccttaaccgttacccgttacgggtttaccgtttacccgtttaccggttacccgttacccgttacccgggtacttaacccggtttcgaaccggttacgtaacccgggtaccgtacggtacccggtgttaaccgggcgggttaccgtaccggtacgggtaccggtaccggttacgaaccgg

SEQ ID NO: 101586 - DNA, 892 bp, Homo sapiens
  misc_feature: GYAE6OF02FTVAO.8.67.G01.1.454.CMB.1.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgcccgggtcaagtcacgaccattacgtactaccttttttaaagttggtaattccaacagacgacccaaggaaaaccgccccccaaactcctgtattttagtaggtgcactcctagttttccgactaaaggttcgggggtacccctagttacgtaacgggtttcagggtacggtacgaggttacgggtagttccggtcggggggacctaagggttaccgtttttccccaacccccttccgtaacccgtattacccgagtaccgtaacggtcttacggaccctaaaccgttaggtaaacgttactttacggacccttaaacctttacgtaacgttcgtactaacggccttaggtaccttacgaaccgggtaccgggacccgggttccttacccggttttcggggacccgggaacggggggtaaccggtaaacggtccgggttaaacggtacggtaaaccggtaaccggtaaaccggttacgttaccgggtacggtccgttacggtaacccctaacccggtagtttaccccggtttacggtttccccgtttaaccgtttacccttacccgggtttttccccgtaactttaccgttaccgtaccggtaaaccggtaaccccgaacggtaccccggtaaccggttcccgggttaacggggtaaccccgggtaccgggggttacccgggtacccggtaaccggggtaaccgggtaccgttaaccccggg

SEQ ID NO: 101587 - DNA, 590 bp, Homo sapiens
  misc_feature: GYAE6OF02GPDPG.8.67.G01.1.454.CMB.1.raw
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (535)..(535): a, c, t, g, unknown or other
  misc_feature (535)..(535): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaaatggtaatcaaacagacgcccaaggaaaaacncccccaaaatcctagatttanggtgcatccatttcgacaaagtgggtcccatacaaggttcaggtggcaggtggatcgtggggcagtactttcaccctcaacctatcacgcaagtctgactaaaccgtgaaacgtactttagactaactttaactactagtacacgtctaagttctaacgacgtacgggtccggtactacgtttcggaccggtaaggggaacgtaagacgtagggaagtaacgtacgaaacgtagtgtacgcgtacgactaccgattcgtgtcttcacttccgtacccnctatcgtagacgacgtacgacgtagcgtgacggtcggcgtaggactacggctacg

SEQ ID NO: 101588 - DNA, 670 bp, Homo sapiens
  misc_feature: GYAE6OF02H58VM.8.67.G01.1.454.CMB.1.raw
  modified_base (164)..(164): a, c, t, g, unknown or other
  misc_feature (164)..(164): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (640)..(640): a, c, t, g, unknown or other
  misc_feature (640)..(640): n is a, c, g, or t
  modified_base (664)..(664): a, c, t, g, unknown or other
  misc_feature (664)..(664): n is a, c, g, or t
tcagctcgcgtgtccacgaccggtgctcgatttagagtatacatattgggtttgggggcttttcctgggctcctgctactctggctccgaggtggccagagtgtcgactatccagactcgaacccagttctccactcctccctggtctcgcttactagtagganacagagtcacctatctacttgccgggtnaaggtcagaaccntacgtcttacttttaatggtactacacgagtacgaccgaacggtaaaccgtacccctaaaacttccgtaggtacttttaacggtgggactactactcctattacgacgtaaggtcgggacctatacgaggttcaggtcgacaggtcgagtcggtagggacaggtacttaccacccgtactacgacttgacagttacgtcgtcacctacgtacgtattacgttcgtaaccttacgttactacgtattacgagttctacgttaccgtagtacgggaccgggttccgtacgttacggtacgggtaacgacgggagttacccgaggttaggacgacggttagaacgttacgtggaccgtctaccgcgtaaccgtacgttccttacgtcttcgtaccgtcgtaaacctcaaccgttcgacgtccgaggtaccgacgttancgtagggcgcggtcgtacggacgntactcg

SEQ ID NO: 101589 - DNA, 588 bp, Homo sapiens
  misc_feature: GYAE6OF01CURDY.15.71.G05.1.454.CMB.1.raw
  modified_base (309)..(309): a, c, t, g, unknown or other
  misc_feature (309)..(309): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcggcgagtcagggtattagcagctggttagctggtatcagcagaaaccagggaaacgcccctaagctcctgatctatggtncatccagtttaggaagtcggggtcccacgaaggttcagcggcagtgaatctgggacagtattcactctacacatcagcagctgcacgcctgagtattttcgactaacttactattcgtacaacgtacggtacttaacgtacgttttaccctcttaccgtaccgttttaccgggacgggtaacgggaacccgtaaagggttagggtaactttacgtaacccgtaaaaaccggtaacgtttacgggttacggtacccttacggacccgtaacccgttaacg

SEQ ID NO: 101590 - DNA, 543 bp, Homo sapiens
  misc_feature: GYAE6OF01A7XN3.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaagtggggtcccacaaggttcagcggcagtgaatcgtgggacagatttcactctcaccatcagcagcctgcagcctgaggtattttgctaacttactattgtacaacaggtacttaactacgtttccctctacctaccgtttcgggccgggtaacgggaccgtaagggtaggaacgttagtaccgaaaacggtaactcggtaggactcggcctaccgtacg

SEQ ID NO: 101591 - DNA, 578 bp, Homo sapiens
  misc_feature: GYAE6OF01CMWJ7.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacgaaggttcagcggcagtgaatcgtgggacagtatttcactctcaccatcagcagcctgcagcctgagtattttgctaacttactattcgtacaacgtaggtacttaacctacgttttacccctcttcctaccgttttccgggaccgggtacggggaacccgtaaggggttgggaacgttaacgtaccgaaaaaccggtaaccgttacgggttacgggaccttcggaccgtaacccgtaacg

SEQ ID NO: 101592 - DNA, 563 bp, Homo sapiens
  misc_feature: GYAE6OF01CSL30.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtcggggtcccacgaaggttcagcggcagtgaatctgggacagtatttcactctcaccatcagcagcctgcagcctgaggtattttgctaacttactatttgtacaactagggtacttaacgtacgttttcccctcttacctaccgttttcgggaccgggtagggtaacccgtaagggttgggaattacgttaccgaaaacggtaacttagggtacgggacttcggcctaccgtaacg

SEQ ID NO: 101593 - DNA, 540 bp, Homo sapiens
  misc_feature: GYAE6OF01EEPHT.15.71.G05.1.454.CMB.1.raw
  modified_base (310)..(310): a, c, t, g, unknown or other
  misc_feature (310)..(310): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtncatccagtttggaaagtggggtcccacaaggttcagcggcagtgaatctgggacagatttcactctcaccatcagcagcctgcagcctgaggtattttcgactaactttactattcgtacaacgaggtacctaactacgttttcccctcttactaccgtttcgggccggtaagggaccgtaagggttggaattactacgaaaacgaacgttggtaggactgccacctacg

SEQ ID NO: 101594 - DNA, 503 bp, Homo sapiens
  misc_feature: GYAE6OF01BJ6WJ.15.71.G05.1.454.CMB.1.raw
  modified_base (449)..(449): a, c, t, g, unknown or other
  misc_feature (449)..(449): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtccacaaggttcagcggcagtgaatctgggacagatttcactctcaccatcagcagcctgcagcctgaggtattttgctaacttactattgtacaacaggacttaacagtttcccctntcactttcggcggagggaccaaggtggatatacaaacgaactgtggctgcacta

SEQ ID NO: 101595 - DNA, 506 bp, Homo sapiens
  misc_feature: GYAE6OF01BVRVP.15.71.G05.1.454.CMB.1.raw
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaagcccctaagctcctgatctatggtgcatccagtttggaaagtggggtcccacaaggttcagcggcagtgaatctgggacagatttcactctcaccatcagcagcctgcagcctgagattttgctaacttactattgtacaacaggtactaactacgtttccctctctacgtttcggcggagggaccgaaggtgatntacaaacgactgtcggntgccactac

SEQ ID NO: 101596 - DNA, 506 bp, Homo sapiens
  misc_feature: GYAE6OF01CA49Y.15.71.G05.1.454.CMB.1.raw
  modified_base (502)..(502): a, c, t, g, unknown or other
  misc_feature (502)..(502): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacaaggttcagcggcagtgaatctgggacagatttcactctcaccatcagcagcctgcagcctgaggtatttgcaacttactattgtacaacaggtctaacagtttccctctctactttcggccggtagggaccgaaggtgatatacgaaacgactgtaggctggcncgta

SEQ ID NO: 101597 - DNA, 498 bp, Homo sapiens
  misc_feature: GYAE6OF01CQU41.15.71.G05.1.454.CMB.1.raw
  modified_base (445)..(445): a, c, t, g, unknown or other
  misc_feature (445)..(445): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgagattttgcaacttactattgtacaacaggctaacagtttccctntcactttcggcggagggaccaaggtggatatcaaacgactagtgntgcnctac

SEQ ID NO: 101598 - DNA, 528 bp, Homo sapiens
  misc_feature: GYAE6OF01CV664.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaaagtggggtcccaccaaggttcagcggcagtgaatcgtgggacagtatttcactctcaccatcagcagcctgcagcctggagtattttgctaacttactatttgtacaactaggtcttaactacgtttccctctccgtacgtttcgggacggtagggtacccgaagggtggaatacgtacaaacgactgtacggctgcacctag

SEQ ID NO: 101599 - DNA, 600 bp, Homo sapiens
  misc_feature: GYAE6OF01DNEV8.15.71.G05.1.454.CMB.1.raw
  modified_base (349)..(349): a, c, t, g, unknown or other
  misc_feature (349)..(349): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaaagtggggtcccacaggttcagcgnagtgaatcgtgggacagtatttcactctacaccatcagcagcctgcagcctgaggtattttgctaactttacttatttgtaccaaacgagggtaccttaaacttcgtttttacccctcttaccgttacccgttttccggggaccggggtaacggggtaacccgtaaaggggttggaaactttaaacgttaacccgtaaaaaccggtaaaccgttcgggttacgggcccgtttacggcccgtaaccctaacg

SEQ ID NO: 101600 - DNA, 599 bp, Homo sapiens
  misc_feature: GYAE6OF01DW689.15.71.G05.1.454.CMB.1.raw
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
tcagtctacgtagccacgaccggtgctcgatttagtgtcgtcgcaagagagagggggtcaggctggaactgaggagcagggtgggggcacttctccctctaacactctccccgctcagctccgtggggctcctgctgctctggttcccaggttccagatgcgacatccagatgagccagtctccatcttccgtgtctgcatctgtaggagacagagtcaccatcacttggtcgggcgagtcagggtatagcagctggtagctggtatnagcaagaaacgaggaaacnccctaagctcctgatctagtggtgcatcgtaggttaggaagtcgggtaccacgtaaagtcagcgacagtnaatcgaggatagtatttcactctacactatcagcacgctgaccagtccgtaggtagttattttacggactaaacgtttacttaagttcgtaacctaaacgtaggtaaccttaacgttaccgttttcccctacgtaccgttacggttccggggtaccgggaaacgggtacccgtaaaggggtaggtaacttaacgtaaccgtaaaacggtacgttacggtcggtacacggtacaccgttaacg

SEQ ID NO: 101601 - DNA, 642 bp, Homo sapiens
  misc_feature: GYAE6OF01BA7XB.15.71.G05.1.454.CMB.1.raw
  modified_base (627)..(627): a, c, t, g, unknown or other
  misc_feature (627)..(627): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatctgtaggagacagagtcaccatcacttggtcgggcgagtcgagggtattagcagcttggttagccgtggtatcagacaacggaaaccgagggaaaccgcccctaagtcttcgtgatctagtggtgctatccgtaaggtttaggaaacggtcggggtacccacgtaaggtcaggcggacaggtagaactcggtagggactagtactttaccaccttcctaccaaccctataccgacgtaccacggtccctaggaccgtaacgtccgtagggtagttactttacgaccttaactttacgttattacgtaccaacgtacgtaacttaaccgttacgtttccctacttacgtaccggtttaccgggacgggtaaacgggtaaccgtaagggttagaacttaacgtaaccgtaaacggtacgtggtacggtntaccgcctacgtacg

SEQ ID NO: 101602 - DNA, 626 bp, Homo sapiens
  misc_feature: GYAE6OF01ANQ5U.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggaaacagagtcaccatcacttggtcgggcgagtcagggtattagcagctggttagcctggtatcagcaagaaaccgagggaaacgcccctaagcctcctgatctagtggtgctatccgtaggtttaggaaaggttcggggtacccaacgtaaggttcaggcggacagtgaatcgtagggactagtactttcacttctacacctatcagcacgcctgcctacgcctaggtaggttattttcgaccttaactttactattcgtaaccaacgtacggtaccttaaccgttaccgttttcccctacgttaccgtaccggttttccggggaccgggtaacgggtaacccgtaaggggttcggtaaattaacgtaacgtaaaaccggtaacgttcggtacggacttacggacctaccgtagttcccg

SEQ ID NO: 101603 - DNA, 531 bp, Homo sapiens
  misc_feature: GYAE6OF01EEO2V.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtacccacaaggttcagcggcagtgaatcgtgggacagtatttcactctacaccatcagcagcctgcagcctgagtatttgctaacttactattgtacaacaggtcttaacgtacgtttccctactctacgtttcggaccgggtagggtaccgaaagggttggaattacgtacgaaacgacgttggtcgactgccactacg

SEQ ID NO: 101604 - DNA, 558 bp, Homo sapiens
  misc_feature: GYAE6OF01DJMHM.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtcggggtcccacgaaggttcagcggcagtgaatctgggacagtatttcactctcaccatcagcagcctgcagcctgaggtattttgactaacttacttattcgtacaacgtaggtacttaactacgttttccctcttacgtaccgtttcgggaccgggtaacgggaccgtaaagggtaggtaacttactaacgtaaacgtaacgttcggtacggccttacgcctaccgtacg

SEQ ID NO: 101605 - DNA, 618 bp, Homo sapiens
  misc_feature: GYAE6OF01C32FR.15.71.G05.1.454.CMB.1.raw
  modified_base (208)..(208): a, c, t, g, unknown or other
  misc_feature (208)..(208): n is a, c, g, or t
  modified_base (318)..(318): a, c, t, g, unknown or other
  misc_feature (318)..(318): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagagtcaccatcacttggtcgggcgagtcgagggtattagcagctggttagcctggtatcagcaagaaaccgagggaaacgcccctaagcctcctgactctagtggtncatccgtaaggtttaggaaaggttcggggtacccaacgtaagggttcaaggcggactaggtagaacgtcgtagggaactaagtactttactactctaccacctatcagactacgcccgtagaccacgtccgtaggtacggtattttcgaacttaactttactatttacgaacctaacgtaggtacctaaacgttcgttttaccctcttaccgttacgtttccgggacgggacggtaacccgtaagggtagtaactaacgtacgaaaaccgtacgttcggtacggtacttacgctactacg

SEQ ID NO: 101606 - DNA, 532 bp, Homo sapiens
  misc_feature: GYAE6OF01B4CW6.15.71.G05.1.454.CMB.1.raw
  modified_base (310)..(310): a, c, t, g, unknown or other
  misc_feature (310)..(310): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccagggaaagccctaagctcctgatctatggtncatccagtttggaaagtcggggtccacgaaggttcagcggcagtagaatcgtagggacagatttcactctcaccatcagcacgctgcagcctgagtatttcgactaacttactatcgtacaacgaagtacttaaaacgtttccctactactaccgttcggacggtagggtaaccgaaggtaggtaatacgtacaaacgaatacggtcgctagcaccgtatcg

SEQ ID NO: 101607 - DNA, 528 bp, Homo sapiens
  misc_feature: GYAE6OF01A4PR2.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaagtgggtcccacaaggtcagcggcagtgaatctgggacagatttcactctcaccatcagcagcctgcagcctgaggtattttgactaacttactattgtacaacgaggacttaactacgtttccctctcctacgtttcgggacggtacgggaccgaagggtggaattacgtacgaaacgtacgtggtcggatcgctaccgtacg

SEQ ID NO: 101608 - DNA, 623 bp, Homo sapiens
  misc_feature: GYAE6OF01AR1CH.15.71.G05.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagtctacgtagccacgaccggtgctcgatttagtgtcgtcgcaagagagaggggtcgaggctggaactgaggagcaggtgggggcgacgttctccctctaacactctccccgctcagctcctgggctcctgctgctctggttcccaggttccagatgccgacatccagatgagccagtctcccagtcttccgtgtctgcatctgtagganacngagtccacctatccactttggccggggcagttcgaagggttattagcagctggttagccttggtatcgagcagaaaccgagggaaacgcccgtaaagctcctgatctagtaggtgacatcctaggttttaggaaaggttccggggtcccaaccgaagggttcaacggcgcgtaggtgaatccgtagggacaggtactttcgactcgttaccaccgtntaccagcctacacgtnacgcgcctggacgttacttttcgacttaactttacttagttctacctaacgaggtccttaaacgttcgtttccctagtaccttaccgttttacggggcccggtaacgggtaacctaaggggttacgtagtacccttaacgaaaccgacgttggtacggactcggacctaccgtta

SEQ ID NO: 101609 - DNA, 528 bp, Homo sapiens
  misc_feature: GYAE6OF01DO6CE.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcaggggtattagcagctggttagcctggtatcagcagaaaccagggaaagcccctaagcctctgatctatggtgcatccagtttggaagtgggtcccacaaggttcaggcgcagtgaatcgtgggacagtatttcactctcaccatcagcagcctgcagcctgaggtattttgactaacttactattgtacaacaggtactaactacgtttccctctcctacgtttcggccggtagggaccgtaaggtaggattactaacgaaacgacgttggtcggctagccaccgtacg

SEQ ID NO: 101610 - DNA, 549 bp, Homo sapiens
  misc_feature: GYAE6OF01DDE9Q.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaccagggaaagcccctaagctcctgatctatggtgcatccagtttggaagtgggtccacgaaggttcagcgcagtgaatcgtgggacagtatttcactctacaccatcagcacgcctgcagtcctgtagtattttcgacttaacttacttagttacgtacaaacgtaggtacttaactacgtttccctctcgtaccgtttcgggcgggtaacgggaccgtaaggtaggaattacgtaacgtaaacgaaacgtggtacggcttcgcgtacctacg

SEQ ID NO: 101611 - DNA, 592 bp, Homo sapiens
  misc_feature: GYAE6OF01ER7IJ.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagccttggtatcagcagaaaaccgagggaaacgcccctaagcctcctgatctatggtgctatcctaggtttaggaaaggtcggggtacccaaccgaaggttccaaggcggcaggtgaactcgtgggacaggtactttcacttctacaccatcacgcacgcctgaccagccgtgagttatttcgactaactttactattcgtaccaacgtacgggtacttaaccgttacgtttcccctacttacgtaccgtttccgggacgggaacgggtaaccggtaagggtggtaacttacaaccgaaaacgtacgtcggttacggacctacgccgacgttacg

SEQ ID NO: 101612 - DNA, 595 bp, Homo sapiens
  misc_feature: GYAE6OF01DARA1.15.71.G05.1.454.CMB.1.raw
  modified_base (357)..(357): a, c, t, g, unknown or other
  misc_feature (357)..(357): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcagggtattagcagctggttagcctggtatcagcaagaaccgagggaaacgcccctaagcctcctgatctatggtgcatcctagtttggaagtggggtcccacgtaaggttcagcgganagtgaatcgtagggacagtatttcacttcctcaccatcagcagcctgctagccgtggagtattttcgacttaactttacttattcgtacaacgtacggtactaacgttacgttttcccctacttaccgttaccgttttccggggaccgggtaaccggggaaccgttaaaggggtaggtaattaacgtaacgaaaaccggtaacgtttcgggtacggcgttacggccgtacccttaacg

SEQ ID NO: 101613 - DNA, 568 bp, Homo sapiens
  misc_feature: GYAE6OF01AKJKN.15.71.G05.1.454.CMB.1.raw
  modified_base (310)..(310): a, c, t, g, unknown or other
  misc_feature (310)..(310): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaacgcccctaagctcctgatctatggtncatccgaggtttggaaacggttcggggtacccacgaaggttcaggcggcagtgaatcgtgggacagtatttcactctcaccatcagcacgcctgcagcctgaggttatttgactaacttacttattcgtacaacgtaggtaccttaaaccgtcgttttacccctcgttacctacgtttccgggaccgggtacgggaaccgtaaagggttcggaatacgtacaaaacggtacgtacgggtcgaccttcgcctacctacg

SEQ ID NO: 101614 - DNA, 568 bp, Homo sapiens
  misc_feature: GYAE6OF01BOHWG.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagccctaagctcctgatctatggtgcatccagtttggaagtggggtcccacaaggttcagcggcagtgaatcgtggacagtatttcactctacacccatcagcagcctgcagcctggagtatttcgacttaacttactattgtccaacgaggtaccttaactacgtttcccctactccgtaccgttttccgggacggtaacgggtacccgtaagggttaggaacgttaactaccgtaaaaccggtacgttaggttacgggacctttacggcctacccgttaacg

SEQ ID NO: 101615 - DNA, 569 bp, Homo sapiens
  misc_feature: GYAE6OF01B0D9V.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcagggtattagcagctggttagcctggtatcagcagaaaccagggaaacgccctaagctcctgatctatggtgcactcctaggtttaggaaacggtcggggtacccaacgtaaggttcaggcggcagtgaatcgtagggactagtatttcacttctaccacctatcgagcacgtcctgacacgcctaggacggttattttcgacttaactttactagtttcgtacctaacgaggtaccttaacgtcgtttccctactaccgttacgtttcgggacggtaacgggacctaagggtgaatactacgaaacgacgtgtacggctcgcctcgtac

SEQ ID NO: 101616 - DNA, 668 bp, Homo sapiens
  misc_feature: GYAE6OF01BTSA6.15.71.G05.1.454.CMB.1.raw
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgaggtcggggtattagcagctggttagcctggtatcgagcaagaaaccgagggaaacncccctaagcctcctgatctatggtnctatccgtaggtttaggaaacggtcggggtacccaacgtaaggttcaggcggacagtagaatcgtagggactagtactttcgacttctacacctataccgagaccacgtccgtacgaccacgtaccgtaggtaacggttatttttacgaaccttaaactttacttaagtttacgtaacctaaacgtacggtaaccttaaaccgttaccgttttacccctaccgttaccgtaccggttttaccgggaccgggtaacggggtaaccgtaaggggttacggtaacgttaacgtaaccgaaaaccggttaaccgttagggttacggtccgttacggacctaaccgtacgtttaccg

SEQ ID NO: 101617 - DNA, 565 bp, Homo sapiens
  misc_feature: GYAE6OF01CUQSG.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacgttgtcgggcgagtcagggtattagcagctggttagcctggtatcagcagaaaccgagggaaacgccctaagcctccgtgatctagtggtgctatccgtaggtttaggaaaggtcggggtacccaacgtaaggttcaggcgcagtgaatcgtagggacagtattcactctcacatcagcacgcctagcagtccgtaggagtattttcgacttaacttactattcgtacaacgtacgtactaactacgtttccctacgttaccgtacgtttaccgggcggtaacggaccgtagggtagacgtacgtaacgaaacgtacgtgtacgacgtcgcgtacgttacg

SEQ ID NO: 101618 - DNA, 568 bp, Homo sapiens
  misc_feature: GYAE6OF01CFKAY.15.71.G05.1.454.CMB.1.raw
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgngtctgcattctgtagganacagagtcaccatcacttgtcgggcgagtcgagggtattagcagctggttagcctggtatcagcagaaacgagggaaacnccctaagctcctagatctatcggtgcatcctagtttaggaagtcgggtacccacgtaagttcgagcgcagtagaagtcgtagggactagtatttccacttcctacactatacacgcacgtcctgcacgccgttagagtattttcgactaacttacttattcgtacaacgtaggtacctaacgttactttcctcttactcgtttcggacggtacgggaccgtagggtagaacgttacgaccgtaaaacgtcgttaacggtggtacttggccaacgttacg

SEQ ID NO: 101619 - DNA, 569 bp, Homo sapiens
  misc_feature: GYAE6OF01E18MF.15.71.G05.1.454.CMB.1.raw
  modified_base (348)..(348): a, c, t, g, unknown or other
  misc_feature (348)..(348): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaagtggggtcccacgaagtcagcgnagtgaatcgtagggacagtatttcactctcaccatcagcagcctgcagcctgagtatttgctaacttactattgacaacgaggtacttaactacgtttcccctcttaccgtacgttttccgggacgggtacgggaacccgtaagggttaggtaacttaacgtaaccgtaaaaccgggtaacctttcgggtacgggtaccgtcggtacccgacccgttaacg

SEQ ID NO: 101620 - DNA, 578 bp, Homo sapiens
  misc_feature: GYAE6OF01DYGBO.15.71.G05.1.454.CMB.1.raw
  modified_base (405)..(405): a, c, t, g, unknown or other
  misc_feature (405)..(405): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaagtcggggtcccacgaaggttcagcggcagtgaatctgggacagatttcactctcaccatcagcagcctgcagcctgaggtntttacgactaacgtttactagttgtacaacgtaggtaccttaaactacgtttacccctcttactaccgttttacgggccgggtaaggggtaacccgtaagggttaggaacttaacgtaaccgtaaaacggtaacgttagggtacgggacctacggtaccgtaacccgttaacg

SEQ ID NO: 101621 - DNA, 567 bp, Homo sapiens
  misc_feature: GYAE6OF01B3OY7.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcgagggtattagcagcgtggttagcctggtatcagcaagaaaccgagggaaacgcccctaagcctcctgatctatggtgcatccagtttaggaaaggtcggggtacccaacgtaaggttcaggcggcagtgaatcgtagggactagtatttcactctacacatcagcagcctgcagctgagtatttgactaattactattgtacaacgaggtactaactcgtttacccctcttacctacggtttccgggaccggtaacgggaacccgtaagggtacggaataacgtaccgaaaacggtaactggtacggaccgtcgacctaccgtacg

SEQ ID NO: 101622 - DNA, 564 bp, Homo sapiens
  misc_feature: GYAE6OF01BQH0A.15.71.G05.1.454.CMB.1.raw
  modified_base (557)..(557): a, c, t, g, unknown or other
  misc_feature (557)..(557): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttcgtgtctgcatctgtaggagacagagtcaccatcacttgtcgggcgagtcagggtattagcagctggttagcctggtatcagcagaaaccagggaaacgcccctaagctcctgatctatggtgcatccagttggaagtcggggtcccacgaaggtcagcgcagtgaatcgtagggacagtatttcactctacacatcagtacgcctgcacgctgtagtattttgactaactttacttattacgtacaacgtacggtacctaacgttacgtttccctcgtaccttacgtttcgggacgggtacgggaaccgtaagggtcggtaattacgtacgtaaacgtaacgttcggtacgggactaggacctaccgtnttacccg

SEQ ID NO: 101623 - DNA, 571 bp, Homo sapiens
  misc_feature: GYAE6OF01D0S64.15.71.G05.1.454.CMB.1.raw
  modified_base (208)..(208): a, c, t, g, unknown or other
  misc_feature (208)..(208): n is a, c, g, or t
  modified_base (426)..(426): a, c, t, g, unknown or other
  misc_feature (426)..(426): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagatcaccatcacttgtcggcagtcagggtattagcagtctggttagccgttggtatcagcgaagaaaaccgaggggaaacgcccctaaaggccttaccgtgatactagtggtgctactacctaggttagggaaaggttcggggtacccaaccgtaaaggttcaggtcggactagtagaatcgtagggaacagtactttcgaacttcacaacctancacgacacgcctggcagtcctagtacgtatttgacttaattactattgtacaacgagtactaactacgtttcctactaccgtacgttcgggaggtacggtacgtaaggtggaatacgagtaaaccgagtctggactcgcactacg

SEQ ID NO: 101624 - DNA, 770 bp, Homo sapiens
  misc_feature: GYAE6OF01DIP7B.15.71.G05.1.454.CMB.1.raw
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagagtcacatctacgttggtccgggcgtaggtcgtagggtattagcagtcgtggttacgccttggtatcgagacgaacggaaaccgaacgggaaaccgtaccccgtaagtccttaccgtagtactcgtagtggtcacctacgtaccgttaaggtttacgggaaacggttccggggtaaccctaaccggtaacggttacgaacggtacggtacgaggttacggtaacgttccggtaacgggaacttaacggttacttttaccgaaccttccctaacccgtaaccctagttaccacggaccgtaccgttccgacggaccgtacgtccggttaaggtaacggttttaacgttttaccggtaaacctttaaaccgttttacgtttaacggtttaacgtaaccgtaaaccgttaacggttaaccctttaaacccgttccgtttttaccctccgttaaccggttaccggtttcggggaaccggtaacggggtaacgtaagggtaagtaacgttaacgtaaccgtaaaggtacgttacgggtacgtaccgtacgtacctacgttacg

SEQ ID NO: 101625 - DNA, 584 bp, Homo sapiens
  misc_feature: GYAE6OF01BUMZA.15.71.G05.1.454.CMB.1.raw
  modified_base (320)..(320): a, c, t, g, unknown or other
  misc_feature (320)..(320): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatctgtaggagacagagtcaccatcacgttggtcgggcgagtcgagggtattagcagctggttagcctggtatcagcaagaaaccgagggaacgcccctaagcctcgtgtatcgtagtggtnctactcgtaggtttaggaacgtcggggtacccacgtaacggttcgacggcgctaggtagaagtcgtaggactagtactttcacttcctacacctatcgacgcacgtcctgcgacgtccgtaggtagttactttcgacttaacttattagtctacaacgtacgtaccttaacgttaccgttccctaccgtacgttacgttcgggacggtaacggtacgaaggtgaatacgacgaaacggttacgtggtcgatcgtaccgcttacg

SEQ ID NO: 101626 - DNA, 717 bp, Homo sapiens
  misc_feature: GYAE6OF01BS0LP.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagacgtcaccatcacttggtcgggcgagtcgagggtattagcagtcgtggttagcctggtatcagacaacgaaaccgagggaaacgccccgtaagcctccgtagatcgtagtggtgctagttccgtaagtttacgggaaaggttccggggtacccaacggtaacggttcgacggcggacaaggttagaacgttcggtagggtaactaggtactttccaccttctaccaccgtatccgagccgaacgtcccgtgaccgtacggtcccgttaggtaacggtttacttttacgaacctttaaacttttacgttaacgtttaccgtaaccgaaaccgtacgggttaacccttaaaccgtttacccgttttacccctacgttaccgttaccggttttaccggggaccggggtaaacgggtaacccgtaaaggggttagtaaacgtttaacgtaacccgtaaaaacggttaccgttagggtacccggtacgttaccgacccgtaacgttaccg

SEQ ID NO: 101627 - DNA, 556 bp, Homo sapiens
  misc_feature: GYAE6OF01A7LW7.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatcagtttggaagtgggtccacgaggtcagcgcagtgaatcgtagggacagactttcactctcaccatcagcagcctgcagcctggagtacttttgactaacttactagttgtactaacgagggtaccttaaacgtacgttttcccctacgttcctaacgtttccgggacgggtaacgggtaacccgtaagggttcggaatacgtacgaaaaccgtactacggtacggacctgacccgacgtacg

SEQ ID NO: 101628 - DNA, 542 bp, Homo sapiens
  misc_feature: GYAE6OF01BAO7L.15.71.G05.1.454.CMB.1.raw
  modified_base (536)..(536): a, c, t, g, unknown or other
  misc_feature (536)..(536): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaacgcccctaagctcctgatctatggtgcatccagtttggaaagtcggggtacccacgaaggttcaggcggcagtgaatcgtagggacagtatttcactctcaccatcagcacgcctgccagcctagtaggtattttgactaacttacttattcgtacaacgtacggtacttaacgtacgtttccctactctacgtttcgggacggtacgggacctaagggtggatactacgaaacgtacgtggtacgctcgcncgtacg

SEQ ID NO: 101629 - DNA, 640 bp, Homo sapiens
  misc_feature: GYAE6OF01D30D4.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagacgtcaccatcacttggtcgggcgagtcgaggtattagcagctggttagcctggtatcagcaagaaaccgagggaaacgccctaagcctcctgatctatggtgcactcgtaaggtttaggaaacggttcggggtcccaacgtaacggttcgacggtcggactaaggtgaaacgttccggagggtaactaaggtactttacgacttcctaccacctaatcaagctacgcctgcgacgtccgtaggtagttactttgaaccttaacgtttactagttacgtacctaacgtacgggtaccttaacgttccgtttaccctacgttccgttaaccggtttccgggaccgggtaacgggtaacccgtaagggttacgggtacttaacggtaaacccgtaaaacgtaacgtggtacgcttacggcctacgttacg

SEQ ID NO: 101630 - DNA, 605 bp, Homo sapiens
  misc_feature: GYAE6OF01B87M1.15.71.G05.1.454.CMB.1.raw
  modified_base (207)..(207): a, c, t, g, unknown or other
  misc_feature (207)..(207): n is a, c, g, or t
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctggttcccaggttccagatgcgacatccagatgagccagtctccatcttccgtgtctgcatctgtagganacagagtcaccatcacttggtcgggcgagtcagggttattagcagctggttagccgttggtatcagacaacgaaaccgagggaaacnccccgtaagctccgtgatctagtggtncatccgtaggtttaggaacgtcggggtccaacgtaagttcgaggcggcagtgatcgtaggactagtattcactctacacctatcacgcacgccgtgacacgtcctagagttatttcgacttaatttctaagttcgtacaacgtcgtaccttaaccgtacgtttcccctcgttaccgttaccggttcgggaccgggaacgggtaaccggtaagggttaggaaacttaacgtaaccgaaaacggttaacggtcggttacggaccgtacggtaccctaccgttaacg

SEQ ID NO: 101631 - DNA, 843 bp, Homo sapiens
  misc_feature: GYAE6OF01D3PYT.15.71.G05.1.454.CMB.1.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatctggtaggagacagagtcaccatcacgttggtcgggcgagtcgagggttattagcaggtcgttggttacgccgttaggtatcgagacaagaaaccgagggaaacncccctaagcctacctgatctagtggtnactatcgtaggtttaggaacggtcggggtacccaacgtaaggtcgacggcggacgtaggtagaacgtcgtaggggaactaggttaacttttccgaacctttaccctaccgtaaccctacgttaccgaacggtacccgtaaacggtccccgttacgggtacccgtaaaccgggtccccggtttaaaggggttaaccggttttaacgtttttttaacccgggaaaccctttttaaaacccggtttttaaaccgttttaagttttacccggttaaacccgtaaacggttaaccgggttaacccttttaaaacccggttttacccgttttttacccccgtaccgttttacccggttaacccggtttttaccgggggaaacccggggtaaaccggggttaaacccggtaaaggggttacggttaaacttaaacccggttaaacccggtaaaaaccggtttaccgttacggggtaccgggttaaccgttaccggtaacccgttaaacccggttaacg

SEQ ID NO: 101632 - DNA, 589 bp, Homo sapiens
  misc_feature: GYAE6OF01DHYUH.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccgagggaaacgcccctaagcctcctgatctatggtgcatccagtttaggaaagtcggggtcccacgtaaggttcaggcgcagtgaatcgtgggacagtatttcactctcaccatcagcagctgcagcctgtaggtattttcgactaactttactattcgtacctaaacgagggtaccttaaacctacgttttacccctcgttacctaaccggttttcgggacccgggtaggggtaacccgtaaagggttcggtaaattacgtaaccgaaaaccggtaacgttggtacggacttacggcctaaccgttaacg

SEQ ID NO: 101633 - DNA, 561 bp, Homo sapiens
  misc_feature: GYAE6OF01AWASC.15.71.G05.1.454.CMB.1.raw
  modified_base (477)..(477): a, c, t, g, unknown or other
  misc_feature (477)..(477): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagcctcctgatctatggtgcatccaggtttaggaaaggtcggggtacccacgaaggttcaggcggcagtgaatcgtagggacagtactttcactctcaccatcagcagcctgcagcctggagtattttcgactaactttactatttcgtaccaacgtaggtaccttaaccgtacgtttcccctnttacctacgtttccgggacgggtaacgggaccgtaggggtagaattacgtaccgaaagtacgtggtacggactcgccacctacg

SEQ ID NO: 101634 - DNA, 679 bp, Homo sapiens
  misc_feature: GYAE6OF01A2PKQ.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatctacgttggtcgggcgagtcgagggttatagcagctggtagcctggtatcagcagaaaccagggaacgccctaagctcctagtatctagtggtgctacgttaccgtaggtttagggaaacggtcggggtacccaacgtaaggttcaggcggtacgtagtaggaatcgtagggaactagtactttcactacctcacctatcgagacacgcctacgcgacgtccgttagacggttatttcgaaccttaacttacttagttccgtaaccgtaacgtaacgggttaaccttaaccgttaccttttacccctaccgtttacccgttaaccgggtttacggggtaccgggtaaaccggggtaacccggtaaacgggttagggaaacctttacggtaaacccggtaaaaccgttaaccggttacgggtttacgggaccgtttacgaacccgttaaccgttaaccg

SEQ ID NO: 101635 - DNA, 715 bp, Homo sapiens
  misc_feature: GYAE6OF01A0A85.15.71.G05.1.454.CMB.1.raw
  modified_base (301)..(301): a, c, t, g, unknown or other
  misc_feature (301)..(301): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgccatctgtaggagacagacgtcaccatccacgttggtcgggcgtagtcgaggggttacttagcagcgttggttagccgtggtatcgagcagaaaccagggaaacnccccgtaagcctcctagacttctagtggtgactatccgtaaggttttagggaaacggttcggggtaccccaacgtaacgggttcaaggcggacgacggttagaactcggtaggggactaagtactttaccacgttacctaccaacctataccgagtccaacggccttagacctacgccgtaggtacgttagtttaccggacttaaacgtttaccttaagtttaccgtaacgtaaaccgtacgggttaacccttaacgttacccggttttacccctacgtaccgtttaaccggttccgggaccgggtaaaccgggttaaccgtaacgggggttacgaaccgtttaaaggtaaccccgtaaaaacgggttacccgttagggtaaccggttaccgtacggtacctacccgtttaacg

SEQ ID NO: 101636 - DNA, 850 bp, Homo sapiens
  misc_feature: GYAE6OF01EGFXG.15.71.G05.1.454.CMB.1.raw
  modified_base (111)..(111): a, c, t, g, unknown or other
  misc_feature (111)..(111): n is a, c, g, or t
  modified_base (188)..(188): a, c, t, g, unknown or other
  misc_feature (188)..(188): n is a, c, g, or t
tcagtctacgtagccacgaccggtgctcgatttagtgtcgtcgcaagagagaggggtcaggctggaactgaggagcaggtggggcacttctccctctaacactctccccgntcagcctcctgggctcctgctgctctggttcccaggttccagatgcgacatccagatgagccagtctcatctccgtntctgcatctgtagagacagacgtacacctatcacgttggtcgggcgtacgtacgtaagggttattacgccgtaaggtccgttaggttaccgtccgttaggtacgtcaggaccgaaaacggaaaacccggagggaaaacccgtcccgtaaaggtccgttaccgtaggtacttacgtaggtcggtacgtacgtaacgttacccgttaaggttttaacgggaaccggttacccggggtaaaccccctaaccggttaaacggttccgacggggtaccggtaacggtaacgttaaccgaacgttaccgggtagggtaaaccttaggtttaaacctttcccgaacctttaacccgtaacctaacccgtttaacgtaccgtaacggtaacgtacgtaccctacggtacccgtaacgtccggttacggtacgttttaccttacggtacccgtttaaaactttcgtaacgtttacgtaaccgaacgtaccgggttaacttttaaacctcgttttaaccccgttatccccgggttttaaaggtcccggggtaaacccggggaacgttaaacccggtttaaacggtacgggtaaacttttaacccgaaaacgggtttaaacccgacggttttacgtccgggtaactttacccgggtacccgtaaacgtttccg

SEQ ID NO: 101637 - DNA, 685 bp, Homo sapiens
  misc_feature: GYAE6OF01EMNV5.15.71.G05.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctggtaggagacagacgtccaccatccacgtttggtcgggcgaggtcgaaggggttattaggcagccgttaggttanccgttaggtatcaggacaaggaaaccgagggaaacnccctaagcctcctgatctagtggnactatacgtaggtttaggaaggtcgggtacccacgtaaggttcaggcgacgtagtagaacgttccgtaggggtaacctaggttactttaccgacgttacctaccgtaacccagttacccgaaggccgtaccggcccttggacctacggtaccgtttgggaacggttttcttttacggaactttaaaccgtttacttaagtttccgtaacaaccgtacggtacttaaacccgttctttcccctacgtaccgttaacggtttccgggaccgggtaagggtaacccgtaagggtggtaaacttaccgtaaccgaaaacggtacgttcggacggtcctacggacctacgtacg

SEQ ID NO: 101638 - DNA, 602 bp, Homo sapiens
  misc_feature: GYAE6OF01BQJO5.15.71.G05.1.454.CMB.1.raw
  modified_base (261)..(261): a, c, t, g, unknown or other
  misc_feature (261)..(261): n is a, c, g, or t
  modified_base (514)..(514): a, c, t, g, unknown or other
  misc_feature (514)..(514): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatctgtaggagacagagtcaccatcacttggtcgggcgagtcagggtattagcagtctggtancctggtatcagcaagaaaccgaggaacgccctaagcctacctgatcgtagtggtgactatccgtaaggtttaggaaacggtcggggtaccctaacgtaaggttcgacggcggacgaggtgaagtcgtacgggactagtactttacgactctacctacctatacgagtaccacgtcctagaccacggtcctaggtacggttatttcgacttaacttatattcgtacaacgtacgtactaaccttcgttaccctntacgttaccgttcgggacggtacggtaacgtaggttacgaacttacgtaacgaaacggtacgtaggtacgtactacgacctacgtacg

SEQ ID NO: 101639 - DNA, 545 bp, Homo sapiens
  misc_feature: GYAE6OF01CABM3.15.71.G05.1.454.CMB.1.raw
  modified_base (289)..(289): a, c, t, g, unknown or other
  misc_feature (289)..(289): n is a, c, g, or t
  modified_base (416)..(416): a, c, t, g, unknown or other
  misc_feature (416)..(416): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcaccttgtcgggcgagtcagggtattagcagctggttagcctggtatcagcaagaaaccagggaaacncccctaagctcctgatctagtgtgcatcctaggtttggaaagtcggggtccacgaaggttcagcgcagtgaatcagggacagtacttcactctacaccatcagcacgcctgccagcctgagtatttnactaacttactattacgtaacaacgaggtactaacttacgtttcccctcttacgtccgttacgggcggaacggtaccgtaagggtgaagttaccacgtaaaacgacgtcgtacggactagcctactacg

SEQ ID NO: 101640 - DNA, 578 bp, Homo sapiens
  misc_feature: GYAE6OF01DYAA7.15.71.G05.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (404)..(404): a, c, t, g, unknown or other
  misc_feature (404)..(404): n is a, c, g, or t
  modified_base (460)..(460): a, c, t, g, unknown or other
  misc_feature (460)..(460): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggcgggcagtcagggtattagcagcgtggttacgcctggtatcagcaagaaaccgagggaacncccctaagcctcngtatctagtggtgctattccgtaggtttagggaacggtcggggtacccaacggtaaggttcaggcggactagtagaatcgtagggactagtatttcacttcncacatcagcacgcctgcacgtcctaggtagttcttttcgaacttaacttactgttnacacgtagtaccttaacgtctttccctgtaccgtacggttccgggaccggtagggtaaccgtaggtagtactaacgtaaccgaaacggtacgttgggacgtacctacgacctacgtac

SEQ ID NO: 101641 - DNA, 768 bp, Homo sapiens
  misc_feature: GYAE6OF01BCKRW.15.71.G05.1.454.CMB.1.raw
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctggttcccaggttccagatgcgacatccagatgagccagtctccatcttccgtgtctgctatctgtagganacagagtcaccatcacttggtcgggcgagttcgaagggtattagacagcgtggttagccgtggtatcgagacaagaaaccgagggaaacgaccctaagctaccagtactacttacgtggtacgctaagttacccgtaaagggttttacgggaaaacgggttaccggggtaacccgtaaaccgtaaaacggggtttccgaaggtaccgggtacgtaaagggttacgtaaacgttccggtacggggaaaccgtaaaggttaactttaccgtaccttaccttaaccgaacctaacgttacgaacgtacgaacgtaccgttcggacgtacgtacccggttaggaacggtttagttttaccgaaccgtttaaactttaaccgttaagtttacggtaacctaaacgaacgggttaaccttaaaacgtttccgtttaccccttacttaaccgttaccgttacggggaccgggaaaacggggtaaccggtaaagggttacggttaaactaaacgttaacggaaaaccgtacggttagggacggtacctaggtaaccccaaaggttacc

SEQ ID NO: 101642 - DNA, 139 bp, Homo sapiens
  misc_feature: GYAE6OF01CTEEH.15.71.G05.1.454.CMB.1.raw
  modified_base (131)..(139): a, c, t, g, unknown or other
  misc_feature (131)..(139): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctnnnnnnnnn

SEQ ID NO: 101643 - DNA, 748 bp, Homo sapiens
  misc_feature: GYAE6OF01BZE19.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtcctccatcttccgtgtctgcatctgtaggagacagagtcacatcacttggtcggcgagtcgagggttattagcagtcgttaggttacgccttaggtactcgaagacaacggaaaaccgaggggaaaaccgccccgtaaagtcctaccgtagacttacgtagtggtcgactaacgttaccgtaaggttttacgggaaaacggttccgggggtaacccaacggtaaacggttcgacggcggacgtaggtaagaactcggtagggactaacggttactttaccgtaccttacaccgtaacctaagtaccgaaacgtccaacggtcccgtacggacctacggtccgtaggtaacggttactttttacgaactttaaacgtttacttaactttacgaactaaaccgtagtaccttaaaccgttacgttttccctaccgttccgttaaccggtttaccggggaaccgggtaaacggggtaacccgtaaggggttaccggtaaacttaaacggtaacccgtaaaaaacgggtaccgtttacgggacggtttacaccggtacccgtaacccgttacgg

SEQ ID NO: 101644 - DNA, 654 bp, Homo sapiens
  misc_feature: GYAE6OF01DNLRZ.15.71.G05.1.454.CMB.1.raw
tcagtctacgtagccacgaccggtgctcgatttagtgtcgtcgcaagagagagggggtcaggctggaactgaggagcaggtgggggcacttctcctctaacactctcccgctcagctcctggggctcctgctgctctggttcccaggttccagatgcgacattcagatgagccagtctccatcttccgtgtctgcatctggtagagacagagtcaccatcacgttgtcgggcgagtcagggtattagcagcgtggttagccgttggtatcgagaccaaggaaaccgagggaaacgcccctaagctccgtgatctagtggtcgcagtacctaggttaggaacggttccggggtacccaacgtaacgggttcacggcggacgtaggtagaacttcgtagggactagttacttacgacttacgtcaaccgatacacggctacgccgtacgccgtagccgttaggtacggttatttacgaaccttaactttacgttagtttaaccgtacgaaaccgtaacgggtacctttaaccgttaccgttttcccctccgttacgttacccggtttacggggacgggtaaccgggaaccgtaacgggttaggtaacttacgttaaacgaaacgtaacgttggtacgtccgtacgccgtacgtacg

SEQ ID NO: 101645 - DNA, 692 bp, Homo sapiens
  misc_feature: GYAE6OF01BZ3Q2.15.71.G05.1.454.CMB.1.raw
  modified_base (215)..(215): a, c, t, g, unknown or other
  misc_feature (215)..(215): n is a, c, g, or t
  modified_base (370)..(370): a, c, t, g, unknown or other
  misc_feature (370)..(370): n is a, c, g, or t
tcagtctacgtagccacgaccggtgctcgatttagtgtcgtcgcaagagagagggggtcaggctggaactgaggagcagggtgggggcacttctccctctaacactctccccgctcagctccgtggggctcctgctgctctcggttcccaggttccagatgcgacatccagatgagccagtcctcctatccttcgtgtctgctatctgtaagganaacagacgtcacctatcgtacttcggcgggcgtagtcggagggttatagcgaggtcgttaggttacgccgttaggtactcgaagacgaaacggaaaccggaacgggaaaccgtccccgtaagtccttccgtagtacgttaacttaggtacgggtntaccgtacgttaccggtaagggtttaagggaacgggttccggggtaccctaacggtaacggttacgacggtacggtacgaggttacgaacgttcggtaggacttagtactacaccgttacgacctagactcgacgacgtaccgctacgacgtacgcgttgtacggtttacttacgaacccgttaatttccttaagttccggtaaactacggtacgtaccgttaacttcccgtttacctcgttacccgttggttacgggccggtaaggtaaccggtaggtacgaattaacgtacgaaactggtcgtacgccgcaccgtgttac

SEQ ID NO: 101646 - DNA, 584 bp, Homo sapiens
  misc_feature: GYAE6OF01CRZDV.15.71.G05.1.454.CMB.1.raw
  modified_base (316)..(316): a, c, t, g, unknown or other
  misc_feature (316)..(316): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcgagggtattagcagctggttagcctggtatcagcagaaaccgagggaaacgcccctaagcctcctgactctagtggtnctatccgtaggtttaggaaacggtcggggtacccacgtaaggttcacggtcgcagtgaatcgtagggacagtacttcactctacaccatcgagcacgtcctgccagccgtagaggtattttacgacttaacttacttattcgtactaacgtacgtacttaactccgtttccctctccgttacgtttcgggacgggtaacgggtaccgtaagggtagtaacttacgtaacgtaaacgtacgttgggtacgtacgtacgcgtaccttacg

SEQ ID NO: 101647 - DNA, 606 bp, Homo sapiens
  misc_feature: GYAE6OF01A7EEG.15.71.G05.1.454.CMB.1.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagacgtcaccatccacttgtcgggcagttcagggtattagcagctggttagccttggtatcagcagaaaccgagggaaacnccctaagcctcctgatctagtggagcatcctagtttggaaacgtggggtcccacgtaacgggttcaagcggcagtcgaatcgagggacagtatttcactctccacctatcgacgtcaacggcctagaccagtccgtaggaggtattttcgacgttaacttacctttagtcgtaacctaagaacggttaccttaaacgtaccgttttcccaccttacgtaccggtttaccgggaccgggtacgggtaacccgtaaagggttcgtaagtacttacggaaacgtacgttcggttacggtatcggtaccgtaccgtacg

SEQ ID NO: 101648 - DNA, 708 bp, Homo sapiens
  misc_feature: GYAE6OF01CRGKD.15.71.G05.1.454.CMB.1.raw
  modified_base (238)..(238): a, c, t, g, unknown or other
  misc_feature (238)..(238): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgctatcgtgtaggagacagagtcaaccatcacgttggtcggngagtcgaggtattagctagtcgtggttacgccgttaggtactcgagacaacggaaaccgaagggaaaccgccctaagtccgtacctagactcgttaagtcggtacactacgtacgtaaggtttagggaaacggttccgggtaaccctaacggtaacggttcgaacggtcggacgtacggtagtaaacgtcggtaagggtaactaacgttactttacacgttacctaccacctaactaccgacgtacctacgtcctaggaccgtacgtcccgttaaggtacggttacttttacggaaccctttaacgtttacgttaagttaccgtaacgtaaccgtacggttaccttaaacccgttccgtttacccctagtttacccgtaccgggtttacgggaaccggttaggaaccggtaagggtataacttaacgtaacgtaaacggtcggtagtacggacctacgtccgtacttacg

SEQ ID NO: 101649 - DNA, 818 bp, Homo sapiens
  misc_feature: GYAE6OF01C1HS4.15.71.G05.1.454.CMB.1.raw
  modified_base (221)..(221): a, c, t, g, unknown or other
  misc_feature (221)..(221): n is a, c, g, or t
tcagtctacgtagccacgaccggtgctcgatttagtgtcgtcgcaagagagagggggtcaggctggaactgaggagcagggtgggggcacttctccctctaacactcctccccgctcagctccgtggggcctcctgctgctctcgtcccaggttccagatgcgacactcagatgacgcctagtcctcctattccgttcgtgtctgctatcgtaggtagganacgagtacgtaccaactatcgtacgttgggtacgggacgtaggttacggtaagggttattacgcgtacggtcggttaggttacgccgttaggtactacgaagaaccgaaacggaaaaccggaaacggggtaaaccctaccccggttaagcccttaccgtagtaacgtttacgtaggtggtactacgttaccgttaccggttaagggttaacgggtaaaccgggttccggggtaaccctaacggtaacggttcgacggtccggaagtagtagtaacgttcggtaaggaacgttactactttccgacctacctactaactacgtacgacgacgtacgtccgtacgacctacggtccgttaaggttaacgtttacgtttaaccgtaacgtttaacctttaacgttacgttaaccgtaacgtaaccggtaaccgttaaccctttaaaccgtttacccgtttaccccgtacgttaccggttaacccggggtttacggaaccggggtaaacggtaaccgggttaaacggtagtaaaccgttaaacggtaacccgtaaacggttacgtcgggtaacgtaccgtaccgtaaccgtacgttacccg

SEQ ID NO: 101650 - DNA, 597 bp, Homo sapiens
  misc_feature: GYAE6OF01AVRLV.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcaggggtattagcagctggttagcctggtatcagcagaaaccgagggaaacgcccctaagcctcctagactctagtggtgctatccgtaggtttagggaaacggtcggggtacccaacgaaggttcagcggcaggtgaatcgtagggactagtactttcacttctccaaccatccgagccaacgtcctagccacgtccgtaggacgttatttcgacttaactttactattcgtaacaacgtaggtaccttaacgtacgtttccctctaccgttacgttcgggaccgggtaacgggtaccgtaggtaggaacttacgtaaccgaaaaggtacgttggtacggacttcggacctaacgtacg

SEQ ID NO: 101651 - DNA, 625 bp, Homo sapiens
  misc_feature: GYAE6OF01CXLTU.15.71.G05.1.454.CMB.1.raw
  modified_base (330)..(330): a, c, t, g, unknown or other
  misc_feature (330)..(330): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtccaaccactcacgttggtcgggcgagtcgagggtattagcagtcgtggttacgctaggtatcagacaagaaaccgagggaaacgacccctaagcctactagactctagtggtacncatcgtaggtttacgggaaggttccggggtaccctaacgtaagggttcgacggtcggataggtagaactcggtagggaactagttatttccgactctaccacctactcgagacagcctagcacgcgtagtaggttacttttgacttaactttactagttacgactaacgtacggtacttaaccgtacgttttccctacgttacgtaccgtttccggggacggtacgggtaaccgtaagggttacgtaattaacgtaaccgaaacgtacgtaggtagaccgtacgccgtacttacg

SEQ ID NO: 101652 - DNA, 861 bp, Homo sapiens
  misc_feature: GYAE6OF01D9TWP.15.71.G05.1.454.CMB.1.raw
  modified_base (211)..(211): a, c, t, g, unknown or other
  misc_feature (211)..(211): n is a, c, g, or t
tcagtctacgtagccacgaccggtgctcgatttagtgtcgtcgcaagagagagggggtcaggctggaactgaggagcagggtgggggcacttctccctctaacactctccccgctcagctcctgggctcctgctgctctggtcccaggttccagatgcgacatccagatgagccagtctcctatcttccgtgtcctgcatcgtagtagganacgagagtacacctatctacgttggtccgggacgagtacgaagggttattagcctaggtcttaggttagccgttggtactcgagtaccgaaacggaaaaccggtaacggaaacctacccgtaaagtccttacccgagtacttaccgtaagtggtcacttacgtaccgttaaggttaacgggaaacggttccggtaccctaacgtaaggttccgaaggtaccggtacgtaacggttacgaaacggttccggtagggtaactaacgggtttactttaccgtaacccgtttcctaacccgttaaccgtaacgttacccggaaccgtacgtaaccggtacccgttacgacggtaacccgggtccgttaacggggtttaacggtttaacgttttaccgtaaaaccgtttaacccttttaacgtaaacgttttaccggtaaccgtaaaccggtaacggttaaccctttaaacccgtttacccgttttacccttaccgtttaacccgttacggggtttacccgggaaaccggggtttaaccgggaaaccgggtttacggtaagggttaaccgttaaccggtaaaaccccggttaaacggtaacgggtttaccggtaccgggtaaccttacccgggtaaaccttacccggttaaaccg

SEQ ID NO: 101653 - DNA, 587 bp, Homo sapiens
  misc_feature: GYAE6OF01CVA9Z.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagagacagagtcaccatcacttgtcgggcagtcagggtattagcagtctggttagccgtggtatcagacaagaaaccagggaaacgcccctaagctcctgatctagtggtgctatccgtagttaggaaagtcggggtacccaacgtaaggttcgaggcggactagtagtaatcgtagggactaggtatttacgactctacacctatcagcacgctgacagcctgaggttactttcgactaactttactagttacgtacaaacgacgtacttaacgttacgtttccctcgttaccgtaccgtttcgggacggtaacgggaccgtaaagggtagtaataacgtaacgtaaaacgtacgtacggtacggtactacgcctaacgtacg

SEQ ID NO: 101654 - DNA, 747 bp, Homo sapiens
  misc_feature: GYAE6OF01AGJH7.15.71.G05.1.454.CMB.1.raw
  modified_base (729)..(729): a, c, t, g, unknown or other
  misc_feature (729)..(729): n is a, c, g, or t
tcagtctacgtagccacgaccggtgctcgatttagtgtcgtcgcaagagagagggggtcgaggctggaactgaggagcaggtgggggcgacttctccctctaacactctccccgctcagctcctggggctcctgctgctctggttcccaggttccagatgcgacatccagatgagccagtctccatcttccgtgtctgcatctggtaggagacagacgtcaccatcacgttgtcggggcgtagtcgaggttacttagcgagtcgttggttagccgtggttacttcgaagaccgaaggaaaacccgaaggggtaaaccgacccccgttaaagtccgttaccctaggtacttacgtaaggttcggttacggactacgttacccgttaagggttttaagggaaaacgggttcggggttaaccccctaacggtaaacgggtttccgaaggtaccggacgtacggtagtacgttacggtaacgggtaacgtagttaaccgtttctaacccgttcctacccaaaccgttacctacgtaccggacctaacggtcccttaggaccaccggtaccttagggtaacgtttagtttacccgtaaacttaacgtttacgtaagttttccaacgtaacgacgttactaaccgttacggtttcccacgttccgttacggtccgggacggtaacggtacgtagggtagttaacgacttacccggtaaataccggtggtaccggnaccgtacgacccttacgg

SEQ ID NO: 101655 - DNA, 747 bp, Homo sapiens
  misc_feature: GYAE6OF01COSW2.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctccccgctcagctcctggggctcctgctgctctcggttcccaggttccagatgcgacactccagatgacgccagtctccattccttccgtgtctgcatcgtggtaaggagacagagtccacctatcacgttggtccgggcgagtcgtagggttatagcagtcgttggttacgtccgttggtactcgaaggaccaaacggaaaccgaacgggaaaccgtacccctaaggtcctaccgtagtaacttcgtaggtcgtacgacctaacgttaccgtaagggtttaacgggaaacggttccggggtaacccaaaccggttaaggttaccgacggtaccggtacgtaaggtacgtaacgttcggtagggaactagttacttacctactccacctaccagtcgacgcgtacgccgtagccgtacgtaccggttaggtaacgtttactttacggtaacccttaacgttttacgttacgttaaccgtaaccgtaaacggtacgttaaccctttaaccgtttacccgtttaccccgttagttaacccgttaccgggtttaccgggacgggtaacgggtacgtaagggttacgtaaacttacgaaaccgtaaacggtacgttcgggactacgttaccgaccttacgtacg

SEQ ID NO: 101656 - DNA, 775 bp, Homo sapiens
  misc_feature: GYAE6OF01DE3BE.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatctgtagagacagacgtccacctatcctacgtttggtccggggacgtacggtaccgtaaggggttattaacggctaaggtccgttagggtttacgcccgttagggttaatccgtaacggacgaaacggtaaaacccggaagggggaaaacccgtaccccccgttaaaggtccccttaccggttaggtaacttccgtttaaggtcgggtttaccggtacctaacgttacccgttaaggggttttacgggaaacggggttacccgggggttaaccctaaacggtaacgggttcgaacggccgggtacgtaagggttacgaacgtttccggacgggtaactaaggttactttaccaccgttacctacctaccaacgttacgaacgtacgtacgtacctggacctaggtctaggtacggttatttcgaccttacgttaactacgttacgtacaacgtacggtacttaccgttacgtttccctacgttccgtaccggttcgggtacgggacggtaccggtaacggttacgtaacgtacgtaaccgtaaacggtacgtcggtacgaccgtacgactacgtac

SEQ ID NO: 101657 - DNA, 677 bp, Homo sapiens
  misc_feature: GYAE6OF01BFQSN.15.71.G05.1.454.CMB.1.raw
  modified_base (212)..(212): a, c, t, g, unknown or other
  misc_feature (212)..(212): n is a, c, g, or t
  modified_base (481)..(481): a, c, t, g, unknown or other
  misc_feature (481)..(481): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcattcgtaggtagganacagactccaccatctacgttggtcgggacgtagtacggtaggttatacgcagtcgttaggtacgtccgtagtactacgacgacgaaacgaaaccggaacgggaaccgacccgtagcctctagtacttactaggtgtgctagtcgttaagggttacggtaacggtccggtaccctaacggtaggtcgacggcgagtaagtagtagtcggtaggaactacttacgttactaccgtctaccgaactacgtacgaatccgaccgtcggtacncgtaccgtcgtaggtacgtttacttacgaaccttaacgttattacgtacgtaaccaaggtaccggttaaccttaaccggtttcctttaccctgttaccgtttaaccggggtaccgggaggggttaaaccggacggttaagggttactaacggttacaaaccgtaaacggtcgtaggtcgaccgtcgaattacgtcg

SEQ ID NO: 101658 - DNA, 668 bp, Homo sapiens
  misc_feature: GYAE6OF01DW04H.15.71.G05.1.454.CMB.1.raw
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
tcagtctacgtagccacgaccggtgctcgatttagtgtcgtcgcaagagagagggggtcaggctggaactgaggagcaggtgggggcacttctccctctaacactctcccccgctcagcctcctggggctcctgctgctctggttcccaggttccagatgcgacactccagatgacgccagtcctccattccttccgtgtctgctattcgtaggtaggagaacctagacgtccactacttctacgttcgggcgggcgacgtacgtaagggttatagcgtagtcgttaggttacgccgttaggtactacgacgacgaaaacggaaaaccggtaacgggaaaacccgtcccgttaaacgccttacccgtaggtaccttacggtagtcgggtacacgttacgttaccgggttagggtttaacgggaacgggttaccccgggtaacctaaccgggtacggtacggacgcggtataaggtacgtaacgtcggaggtaactattactcctaccgtcaccaactctagcgaactactcgtacacgtcgtacgtgtacgttattaccactttaatctatacgataacgtaccgtacttaacgttctttcccgattaccgtcggtacggacgtaacgtagcgtatactaanaacggancgtagcgatccgaatctac

SEQ ID NO: 101659 - DNA, 721 bp, Homo sapiens
  misc_feature: GYAE6OF01EETNW.15.71.G05.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (360)..(360): a, c, t, g, unknown or other
  misc_feature (360)..(360): n is a, c, g, or t
  modified_base (540)..(540): a, c, t, g, unknown or other
  misc_feature (540)..(540): n is a, c, g, or t
  modified_base (559)..(559): a, c, t, g, unknown or other
  misc_feature (559)..(559): n is a, c, g, or t
  modified_base (601)..(602): a, c, t, g, unknown or other
  misc_feature (601)..(602): n is a, c, g, or t
tcagtctacgtagccacgaccggtgctcgatttagtgtcgtcgcaagagagagggggtcaggctggaactgaggagcgagggtgggggcacttctccctctaacactcctccccgctcagcctccgtggggctcctgctcgctctcggtttccctacggttccagatgcgacactccagatgacgccagtctccatcttccgtgtctgcnactcgtggtaggnacgacgacgtcaacgtactaccgtacttcgtaccggttcggtacgggtacggtacggttccgttacgggtagttaaggtccgtaggtacgttacggttacggtaccgttacgaaacgtaccgtaacggaacgaaccnttaaaaccgggtaaacggtccccggtaaaccgtaccgtaccgtcggtacgtacgacccgtacgtaccggttacggtaacgtacgaccgtaacggttacgggtaaccggtacggtaccacgggtacggtaacgacggtacgacgttaacgtacgtacggtacgtacggtacttctactacnactcaaccgactacgtccntaccgtaccgtaccgtcgtacggtacgttacgaccagttttnntacggttaacgtttaacgtttaccgttaaaccgtaaccggttcccgtaacgtaacggttacccgtaccgtaacgtaccttaccgtacggttacgttaccgtacggtacggtacggtacg

SEQ ID NO: 101660 - DNA, 542 bp, Homo sapiens
  misc_feature: GYAE6OF01AMQVU.15.71.G05.1.454.CMB.1.raw
  modified_base (461)..(461): a, c, t, g, unknown or other
  misc_feature (461)..(461): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttaggaaagtggggtacccacgaaggttcagcggcagtgaatcgtgggacagtatttcactctcaccatcagcagcctgcagcctgagtatttcgctaacttactagttgtacaacgaggtaccttaactcgttttcccctnttcctaccgtttcgggacggtacgggtaccgtaagggtcgaatactaccgaaacgtacgtggtacggactcgcctacgtac

SEQ ID NO: 101661 - DNA, 743 bp, Homo sapiens
  misc_feature: GYAE6OF01A3XF4.15.71.G05.1.454.CMB.1.raw
  modified_base (360)..(360): a, c, t, g, unknown or other
  misc_feature (360)..(360): n is a, c, g, or t
tcagtctacgtagccacgaccggtgctcgatttagtgtcgtcgcaagagagagggggtcaggctggaactgaggagcagggtgggggcacttctccctctaacactctccccgctcagctcctggggctctgctgctctggttcccaggttccagatgcgacatccagatgagccagtctccatcttccgtgtctgcatcgtggtaggagacagacgtcaccaatcctacgtttggtcgggacgagtcgtaagggtacttagctaggtcgttaggttacgccgttggtatcgaagacaacggaaaaccggaggggaaaccgtccccgtaagtcctaccgtagagttactacgtgggtacnctagtccgttaaggtttagggaaacgggttccgggtaacccctaacggtaagtcgacggtcggacgtaggtacgtaagtccggtaagggacctaggttactttaccaccttacctacgacctatacgacgtccgaacgtccgtagacctacgtcccggtaggtaacggttacgtttacaaccgttaacttttaacttacgttaccgtaaccgtaaccggtaaggttaccttaaaccttaccgtttaccccttcgttaccgttaaccgggtttaccggggaaaccggtaagggtaacccgtaggggttaacggtaactaacggttaaacccgtaaaacggtaccggttagggttacccggagttcgtaaacccggtccttaacg

SEQ ID NO: 101662 - DNA, 774 bp, Homo sapiens
  misc_feature: GYAE6OF01DOFYK.15.71.G05.1.454.CMB.1.raw
  modified_base (216)..(216): a, c, t, g, unknown or other
  misc_feature (216)..(216): n is a, c, g, or t
  modified_base (765)..(765): a, c, t, g, unknown or other
  misc_feature (765)..(765): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacactccagatgagccagtctccagttcttccgtgtctgcatcgtgtagagacagngtcacatcacgttggtcgggcaggtctagggtattaggctagtcgttggttacgtccgttggtatacgacgactaacggaaaaccgaacggggaaaccgtcccccgtaaaggccctttcccgtaggtacttacgttaggttcgggtacgtacctaacgttacccgttaagggttttacgggtaaaacggttcccgggggtacccctaacggtaaacggtttccgacggtccggacgtaagggttacgaacgttccgggttacgggaaaccttaggtttacgtttacctacctttacccgtacctaaaccctagttaccgacgtacgtaccgtccgtcggacctaccggtcgttacggttaacgtttacgttttacgaacctttaactttacgtttagttaaccgtacgaacgtacggtaccttaaaccgtttcccttttaccctaccgttaccgttaccggtttccgggacgggtaaccgggtaaccgtaagggttagtaacgttaccgtaaacgtaaaccggtaacgtcggttacggtactcgtaccnccgtttaac

SEQ ID NO: 101663 - DNA, 804 bp, Homo sapiens
  misc_feature: GYAE6OF01AN3LT.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctccccgctcagctcctgggctctgctgctctgtcccaggttccagatgcgacatccagatgagccagtcctccattccttcgtgtctgctatcgtggtaggagacagacgtcacctatcctacgttggtccgggcgtaggtacgtagggttattagcgtagtcgttaggttacgtccgttggtactcgagacgtaacggaaaccgaacggggtaaaccgtaccccgtaacgtccgtaccgtagtacttaccgttaggtcggtacgtacctacgttacccggttaaggtttaacggggtaaaccgggttaccgggggtaaccccgtaaccggttaacgggtttacggacggtaccgggtacgtaagggtacgtaacggttacggtaacggggtaaccgtaacggttactttaccgtaaccttaccgtaccaaccgttacgtaacgtaccgaccgtaccggtccgtaccggtaccgtaccgtacggtacgggttacggtttaattttacccgtaacgtttaaacctttacgtttaacgttaccgtaacgtaaaccgtaccgttaacctttaaccgtttacccgtttaccctacgttaccgttaccgggttacgggtaaccgggtacggtaaccggtagggtacgtaacgttaccgacgtaaaccgtacggttcgacgtaccgtacgaccgtcgttaccg

SEQ ID NO: 101664 - DNA, 727 bp, Homo sapiens
  misc_feature: GYAE6OF01BEDPS.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacgttgcgggcgagtcagggtatagcagcgtggtagcctggtatcagcaaggaaaccagggaaacgaccctaagcctcctagatctagtggtcactataccgtaaggtttagggaaacggttccgggggtaccccaaccggtaaagggtttcccgaaggaccggacgtaaggtggaaacttccgggtagggaacctaagttacgttttaccaaccgttacctacctaacccgtattaccgaacgtccgtaacgccgtacggcccaacgtcccgttaggtaacggttattttaccggtaacttaacctttaacttacgtttacgttaaccgaaacgtaacgggttaaccctttaaaccgttaccggtttttaccccctacgtttaccttaccggttttaccggggaccggtaaacgggggtaacccgtaaaggggttacggtaaacgttacgtaaacccggtaaaaccgtacgttacggtaggtaccctacgcccgtaacgtaccg

SEQ ID NO: 101665 - DNA, 572 bp, Homo sapiens
  misc_feature: GYAE6OF01BWSH5.15.71.G05.1.454.CMB.1.raw
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcagggtattagcagctggttagccgtggtatcagcaagaaaccgagggaaacgcccctaaggcctccngactcgtatcggtgcatccgtagtttagggaaaggtcggggtcccaacgtaaggttcaggcgacgagtcgaatcgtagggactagtattttacaccttctacgaccatcacgcaagcctagcngacctgagtatttacgactaacgttactagttcgtanaacgtagtacttaactactttcccgtctcgtacggtttcggaccggtaaggaccgtaaggtagaatacgaacgaaacgtacgtggtacggcncgtccnccgtaacg

SEQ ID NO: 101666 - DNA, 798 bp, Homo sapiens
  misc_feature: GYAE6OF01DDJNA.15.71.G05.1.454.CMB.1.raw
  modified_base (192)..(192): a, c, t, g, unknown or other
  misc_feature (192)..(192): n is a, c, g, or t
  modified_base (292)..(292): a, c, t, g, unknown or other
  misc_feature (292)..(292): n is a, c, g, or t
tcagtctacgtagccacgaccggtgctcgatttagtgtcgtcgcaagagagagggggtcaggctggaactgaggagcaggtgggggcacttctccctctaacactctccccgctcagctccgtgggctcctgctgctctggttcccaggttccagatgcgacatccagatgagccagtctccattcttccgngtctgcatctgtaggagacagtacgtaccacatcacgttggtaccgggcgaggtcgaggggttattacgcgtagtcgttaggttacgtccgttggttaancgaagaccgaaacggaaaaccggaacgggaaaaccggtaccccgtaacggtacctaccgtacggtaacttccgttaaggtacgggtacgtaccgtaacgttacccgttaaagggtttacgggtaaaaacgggttccggggttaaccccgtaaacgtaaacgggtttccgaacggccgggtaacgtaggtaggtaaacgttcggtacgggtaactaaggttaactttctaacttaccgtacgaacctagttacgacgaccgtaacgtccgtacgaccgtacgtacgttacggtaacggtttacgtttaccgtaactttaacctttaacgtttagttaaccgtaactaacggtaaccgttaacgttaacccgtttaccgtttaccgttaccttaccggttaaccggtttacgggaaccgggttaaaccgggaaaccggtaagggttaacggtaacgtaacgtaaaccgtaaaaccgattacggtacggtatacgaccgtacgttaccg

SEQ ID NO: 101667 - DNA, 752 bp, Homo sapiens
  misc_feature: GYAE6OF01B2QP8.15.71.G05.1.454.CMB.1.raw
  modified_base (211)..(211): a, c, t, g, unknown or other
  misc_feature (211)..(211): n is a, c, g, or t
tcagtctacgtagccacgaccggtgctcgatttagtgtcgtcgcaagagagagggggtcaggctggaactgaggagaaggtgggggcacttctccctctaacactcctccccgctcagctcctggggctcctgctgctctggttcccaggttccagatgcgacatccagatgagccagtctccatcttccgtgtctgcatcgtggtagganacagagtcaccatcacgttggtcggcgtagtcgagggtattagctagtcgtggttacgcctaggtactcgagacaacggaaaaccgaaggggaaacccaccccgttaaggacctttccgtagactttaccgtaagtggtacgtacgtaacttacccggttaaagggtttaacgggtaaaaccgggttccgggtaacccccgtaaacggttaaacgggttaccgtaaacgggtccgggaactaggttaacggtaacgttaccgggtagggaacctaggttactttaccgaccttctaccaacctataccgagaccacgtcctagacctaggccgtaggtacgttagtttaccgaactttaacgttattacgttacgaccgtaaacgacggttaaccttaaccggttaaccttttccctacgttacccgttacgtttaccgggacgggtaaaccggtaaccggagggttacgtaacgttaacgtaaaccggaaaaccgttaggttcgggtacgtaccggttacaaccgtccgttacgttaccg

SEQ ID NO: 101668 - DNA, 815 bp, Homo sapiens
  misc_feature: GYAE6OF01BGRBE.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctgggctcctgctgctctcggttcccaggttccagatgcgacactccagatgagccagtcctcctattccttccgtgtctgctatcgtggtaaggagacaggacgtccaccgatctacgttggtcgggcgagtcgagggttattagcagtcgttggttacgtcgttaggtatcgagacgaacgtaaaccgaacgggtaaccgacccgtaacgtccgttccgtagtacttacgttagtcggtctccgtaacgttacccgttaagggtttaacggggtaaacgggttccggggggtaacccctaaaccggttaaacgggttacggacgggtacggtacgtaggttaacgtaacggttacggtacggggaacgttaagttacgtttaccctaccttacccgtaccgttaaccgtactaccggtaacgtacccgtaccggtcccgtaacggacccgacggttccggttaaggttaacgggttttacttttacgtaaaccctttaacgtttaaccgtttacggtttaacgttaaccgaaacgttaacggtacctttaaacccgtttcccgtttacccgtccttaccgttaccggttccgggaaccgggtaacgggtaaccggtaacggttagaccgttaaacgtaacccgtaaacggtaaccgttcgggtaacggtcccgtacggtcccgtacgttaccg

SEQ ID NO: 101669 - DNA, 890 bp, Homo sapiens
  misc_feature: GYAE6OF01EDV0I.15.71.G05.1.454.CMB.1.raw
  modified_base (157)..(157): a, c, t, g, unknown or other
  misc_feature (157)..(157): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctcgtcggttccaggttccagntgcgacatccagatggagtccagtcctcctattccttcgtgtctgcctagtcgtaggtacggaagaaccgagtacgtaccaacctacttaccgtaccgtttcgggccggggtacgggtacggttaccggtaaggggtttaacgtttacggcgtaacggtccggtttacggggtttacggtcccgttaggtacgtacgaggaacccggaaaacggaaaacccgggtaacggggaaaccccgtaccccgttaaacggtcccgtttacccgtaggttacgttacgttagggttcggtacgttaccgtaacggttaccgggtttaagggtttaacggggtaaacgggtacccggggtaacccaaacgggttaacggttacgacggtacggtacggttaacggtacgtaacggtaccgggtaaggtaaccgtagtttaaccgttccttacctaccgtaccaaccgttacgtccgaacgtcgtaaccggtccaggtacccgaacgggtttccgtaagggttaacgtttacgtttaccgttaaactttaaccgtttagttacgttaccgaaccggttaagaaccggtttaacccttttacccggttccttaccctttacggtaccgttaccgggtacggggtaaccggtaagggtaaccggtaggttaccggtaataaccggtaaaccggttaaagccgggttaggttacccgtaggtaacccggtctacccgggtttac

SEQ ID NO: 101670 - DNA, 818 bp, Homo sapiens
  misc_feature: GYAE6OF01DXED6.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctccgtgggctcctgctgctctcggttccaggttccagatgcgacatccagatgacgccagtcctcatcttccgtgtctgcatctaggtaggacgacagacgtccacatactacgttggtacgggagagtcgtaagggtattagcagtcgttaggttacgccgttaggtactcgacgaacaaacggaaaaccggaacgggaaacctccccgttaaagtcccgttaccgtaggtaccttacgttaagttcgggtactaccgtaacgtttacgttagggtttaacggggtaaacgggtaccgggggtaaaccctaaaccggtaaacggggttccgaacgggaccggtaccgaaggttaacgtaaacggtccggtaaaggggaacctacgttaactttacccgtacgttaccctacctaaccgtacgtacgacgtacctaccgtccgtacgtaccgtacggtaccgtacggttaacggtttactttaccgtaaccgtttaactttacgttaacgtttacgttaaccgtaacggtaaccgttaacccgttacccgtttaacccgtttacccgttaccgttaaccggttccgggtttaacgggaccgggtaaccggggttaaccgtaaacgggttaacgttaacgttaacgtaaaccgtaaaccggtaacgtacggtacggtacgtacgtacccgtaccgttaacg

SEQ ID NO: 101671 - DNA, 666 bp, Homo sapiens
  misc_feature: GYAE6OF01B1FVN.15.71.G05.1.454.CMB.1.raw
  modified_base (532)..(532): a, c, t, g, unknown or other
  misc_feature (532)..(532): n is a, c, g, or t
  modified_base (625)..(625): a, c, t, g, unknown or other
  misc_feature (625)..(625): n is a, c, g, or t
  modified_base (644)..(644): a, c, t, g, unknown or other
  misc_feature (644)..(644): n is a, c, g, or t
  modified_base (662)..(662): a, c, t, g, unknown or other
  misc_feature (662)..(662): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctcggttcccaggttccagatgcgacatccagatgagccagtctccattctttccgtgtctgctatcgtaggtaggagacagatccacatcacgttcggtcgggcgaggtcgtagggtattagcaggtcgttggtacgccgttggtatcgagacgaaacggaaaccggacgggaaaccgtcccgtaagtcctccgtagactttcgtagtgcgactagttaccgtaggttaagggaacggtccggtaccctaaggtaacgtcgacggtcgactagggtactacgtcggacggactagttcttacctaccgtcctaccgtaccacgtacaccgctaccggctacggacctaacgtccgggttagtaacggtttgttaaccgtactttaaaccgtttnttacgttactaaccgtaaacgtccgtaaccgtttaaccttcgtttaaccctcgttaccgtacggttccgggacgtaacgggtacgtagggtanaacgttaccaacggttaancggtcgtggactcaactntacg

SEQ ID NO: 101672 - DNA, 679 bp, Homo sapiens
  misc_feature: GYAE6OF01EXLVI.15.71.G05.1.454.CMB.1.raw
  modified_base (89)..(89): a, c, t, g, unknown or other
  misc_feature (89)..(89): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (488)..(488): a, c, t, g, unknown or other
  misc_feature (488)..(488): n is a, c, g, or t
  modified_base (526)..(526): a, c, t, g, unknown or other
  misc_feature (526)..(526): n is a, c, g, or t
  modified_base (538)..(540): a, c, t, g, unknown or other
  misc_feature (538)..(540): n is a, c, g, or t
  modified_base (613)..(613): a, c, t, g, unknown or other
  misc_feature (613)..(613): n is a, c, g, or t
  modified_base (658)..(658): a, c, t, g, unknown or other
  misc_feature (658)..(658): n is a, c, g, or t
tcagtctacgtagccacgaccggtgctcgatttagtgtcgtcgcaagagagaggggggtcaggctggaactgaggagcaggtgggggcncttcctcctctaacactcctcccgctcacgctccgtcgggctcctgctcgctctggttcccaggttccagatcgcgacatccagatgacgccacgtctcctactcttccgtcgtctgcatacgtagtaacggagacacgacgtactacctacgttacgtacgttcggctacgggtccggtaaggtacgtacgggtaacgttacggtccgagttncggttacggttacggaccgttacggttaacgtnaacctaacggacgtnaaaaccggccggtaaacggaacccgtaaccgtaccgtaccgtacgtaccgtacgtacgttacggttagtacgtacgtaccgtacgttacggtaacggttacgggtaccgtacgtccgacggtacgtacgacggacgntaggtacggtaacgtcgtacggtacgtacgttactttnacctacctaccnnnctaccgtaccgaacgtacgacgtaccgtacgtccgtacgtaccgaacgtaccgttacgttacgtacgttacgncgtaacttaacttacgttacgtacgtaacgtacgtaccgtaacgntttacccgttccgtcgtaccg

SEQ ID NO: 101673 - DNA, 775 bp, Homo sapiens
  misc_feature: GYAE6OF01A6CKU.15.71.G05.1.454.CMB.1.raw
tcagtctacgtagccacgaccggtgctcgatttagtgtcgtcgcaagagagagggggtcaggctggaactgaggagcaggtggggcacttctccctctaacactctccccgctcagctcctgggctcctgctgctctcgttcccaggttccagatgcgacatccagtatgacgcctagtcctccattccttccgtgtctgctatcgtgtaggatacgagtacgtaccacgtactcgtaccgtttggccggcgtaacgtgtaacggggtattacgcgtacggtcgtttacggttacgtcccgttagggttaacaccgtaacgacgaaacggaaaaaccggtaacgggaaacccgtacccgtaacgtccttaccgtaggtaactccgttaggtcggtcgacttacgttaccggttaaggttagggtaaaccggttccggtaacccgaacgttacggtacgacggcgtacgtaggtagacgtacgtaggtaacctaagttcctttaccgaccttccgtaactacccgttactcgaacgtccgaccgtaccgtacgacgaccggttgttaacgggttacgtttacgtttaacctacccgttttaacttaaccgtttgaaccgttaactaaccgggtacttaaccttaacccgttacctttccccacgtttaacccgggtcgtttaacccggggagttaaaccgggacttaacgggtaacggtacttaaaccggtaacgtaaacggttaacgtcggtaacgtcctacgcttaacccgtcg

SEQ ID NO: 101674 - DNA, 802 bp, Homo sapiens
  misc_feature: GYAE6OF01ESIGW.15.71.G05.1.454.CMB.1.raw
  modified_base (293)..(293): a, c, t, g, unknown or other
  misc_feature (293)..(293): n is a, c, g, or t
  modified_base (593)..(593): a, c, t, g, unknown or other
  misc_feature (593)..(593): n is a, c, g, or t
tcagtctacgtagccacgaccggtgctcgatttagtgtcgtcgcaagagagagggggtcaggctggaactgaggagcagggtgggggcacttctccctctaacactctccccgctcagctccgtggggcctcctgctgctctggttcccaggttccagatgcgacatccagatgagccagtcctccattccgttccgtgtctgctattcgtagtaaggacgaacaggtacgtaccaacctatcctacgtttcggcggacgtagtacgtagggttattagcagtcgtaggttcnccgtaggtatacgagaccgaacgtaaaaccggaacgggaaccgaccccgttaaggtccctacctaggtaacttcgtaagtcgggttagacctacgtttaccggtaaggtttaggggtaaaaccgggttcccgggggtaaaccctaaaccggttaaacgggttaccggaaccgggtaccggtaacgttaagggttaaacggtaacgtttaaccgggtacggggtaaacttaaacggtttaacttttacccgaacctttaccgtacccctaaaagtctaacggacgtaccgtacgtccgtanacccgtaggtacccgttaaggtacgtttaacgtttcaacctttaaccgtttagtacgttacgtaccaaacgttacggtaaccttacgtttacccttcccgtacttcccgtttacgggttacgggacgggtaaacccggtaaggtaggttagtaacttaccgaaacgttaaacgcgggttaacgtccggaacttaccgccctaccgttcg

SEQ ID NO: 101675 - DNA, 682 bp, Homo sapiens
  misc_feature: GYAE6OF01DSEI3.15.71.G05.1.454.CMB.1.raw
  modified_base (464)..(464): a, c, t, g, unknown or other
  misc_feature (464)..(464): n is a, c, g, or t
tcagtctacgtagccacgaccggtgctcgatttagtgtcgtcgcaagagagagggggtcaggctggaactgaggagcaggtgggggcacttctccctctaacactctcccgctcagctcctggggctcctgctgctctcggttcccaggttccagatgcgacatccgagatgagccagtctccattcttccgtgtctgcatctgtagatacagagtcacattcacttggcggcgagtcagggtattagcagtcgtagtacgctagtatcgagacacgtaaacgacggaaacgtccctaagtctacgtgtacttacgtagtcgtagtctaacttccggtaaagtttaggggaaaacggttccgggggtacccctaacggttaaacggggttcaacgggtccggtaacgtacggtacgtaacgtcgggtaaggaactacgttacgtttccaactcgtacaacctancgacgcacgtcgtagaccgtacgtccgtaggtacggttacggtttacaaccttaactttacgttattacgtaacgtaacgtaacggtaaccgttaactttaccgtttacccgtattacccttacgggtttccgggacggggtaacgttaaccgtaagggttagtaattacgaaaccgaaggttaaccgtggttacgggattaacgccgtacgttaacg

SEQ ID NO: 101676 - DNA, 671 bp, Homo sapiens
  misc_feature: GYAE6OF01BV60K.15.71.G05.1.454.CMB.1.raw
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
tcagtctacgtagccacgaccggtgctcgatttagtgtcgtcgcaagagagagggggtcaggctggaactgaggagcaggtgggggcacttcgtccctctaacactctccccgctcagctcctggggctcctgctgctctggttcccaggttccagatgcgacatccagatgagccagtctccatccttccgtgtctgcatcgtgtaggagacagacgtcaccatcacgttgtcgggngtagtcgagggttattagcagcgtggttacgctggtatnagcaagaaccgaggaacnccgtaanctcngatntatgtncnctctagttaggaacgtcggggtacccacgtaggtcacggacgcaggtagacgtcggtacgggactaaggttactttcgaaccttccgttaccacctatacgacggtacacgtcgttacgacctacggtcccttagggacggtttacgttttacgtaccgttaaacctttgttacttacgtaccgaactacggtaacccttaacgttacccttttccccgtccttaccgttaccgggtttaccggggaccggggtaaaaccgggtacgttaaccggggtaggttaaccgtaacggtaaaccccgaaacggttacggttacggtacggaccgtttaccgaccgtaccgttaaccg

SEQ ID NO: 101677 - DNA, 641 bp, Homo sapiens
  misc_feature: GYAE6OF01B1D47.15.71.G05.1.454.CMB.1.raw
  modified_base (240)..(240): a, c, t, g, unknown or other
  misc_feature (240)..(240): n is a, c, g, or t
  modified_base (346)..(346): a, c, t, g, unknown or other
  misc_feature (346)..(346): n is a, c, g, or t
  modified_base (552)..(552): a, c, t, g, unknown or other
  misc_feature (552)..(552): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatcgtgtaggagacagacgtaccaccatccacgttggtcgggngagtcgaggggttattagcagtcgttggttacgccttggtatcgagacaacggaaaaccgaggggaaaccgccccgttaaagccttccgtgtacttctagtcggtnctatacgtaagtttagggaaaggtcgggtacccaacgtaaggttcacggcgcgagtacgaagtcgtaggactagttactttcactcctacacctatcgacgtcgaccgtctcgaccgtagtccgtacggtaggttactttacgaaccttaactttaacgttacttacgttaacaaccgtagtaaccgttaacttacccgtttcccncgttccgtacggtttcgggaccggaacgggtacgtaggtagtaactacgtaaccgtaaagtacgtaggtacggactcgactaccgtacg

SEQ ID NO: 101678 - DNA, 661 bp, Homo sapiens
  misc_feature: GYAE6OF01BLEJH.15.71.G05.1.454.CMB.1.raw
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (512)..(512): a, c, t, g, unknown or other
  misc_feature (512)..(512): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatccttcgtgtctgcatctgtaggagacgagagtccaaccatctacgttggtcgggcgtaggtcgtagggttattagcgagtcgttggttacgccgtggtatcgaagtaacgaaaccgagggaaacncccctaagtcctacctgacttacgtagtggtacnctacgtccgtaggtttagggaacggttccgggtaccccaacgtaaggttcgacggaccggacgtagtacgtaagtccggtagggactaacggttactttacccgtacttccgtacccaacctactacgacgtcacgtccgtagaccgtacgtaccgtaggtaaggtttntttacgaacttaactttactagttcgtaactaacgtacgtaccttaacgttccgtttccctacttccgtacgtttcgggacggtacggaacgtaggtacgtataacgtacgaacgttacgtcggtacgcgttagacctacgtgtttccg

SEQ ID NO: 101679 - DNA, 752 bp, Homo sapiens
  misc_feature: GYAE6OF01BQ501.15.71.G05.1.454.CMB.1.raw
  modified_base (216)..(216): a, c, t, g, unknown or other
  misc_feature (216)..(216): n is a, c, g, or t
  modified_base (288)..(288): a, c, t, g, unknown or other
  misc_feature (288)..(288): n is a, c, g, or t
tcagtctacgtagccacgaccggtgctcgatttagtgtcgtcgcaagagagagggggtcaggctggaactgaggagcagggtgggggcacttctccctctaacactctccccgctcagctccgtggggctcctgctgctctggttcccaggttccagatgcgacatccagatgacgccagtctccattccgttccgtgtctgcatcgtagtagganacagatccactatctacgttggcgggcgagtcgaagggtattagcgaagtcgttggttagccgttggttacncgagaccaaaggaaaaccgaacgggaaaccgaccccgtaagtcccttacctagacttacgtacgttggtacgacgtacgttcgtaaggtttagggaaaacggttccggggtaacccaacggtaacggttccgaacggcggtacgtaaggttaaggacttacgggtacgggaaactaggtttaacctttccaccgtttaccctaaccaaccgttaacgtacgtaaacggtaccaaccgcccgttacgacccgagtacccgttagggtacggtttactttaccggtactaactttaacgttacgttaacgactaacgtcgtaaaccttacgtttaccgtttcccttacgttaccgttacccggtttacgggacccgggtaccgggtaaaccggtaagggttacggtaacttaaccgttaacgaaaaccgtcggtagggttccgtacggtcctacggacctttacgg

SEQ ID NO: 101680 - DNA, 803 bp, Homo sapiens
  misc_feature: GYAE6OF01E2NZ7.15.71.G05.1.454.CMB.1.raw
  modified_base (379)..(379): a, c, t, g, unknown or other
  misc_feature (379)..(379): n is a, c, g, or t
tcagtctacgtagccacgaccggtgctcgatttagtgtcgtcgcaagagagagggggtcaggctggaactgaggagcagggtgggggcacttcctccctctaacactctccccgctcagctcctggggctcctgctgctctggttcccaggttccagatgcgacatccagatgacgccagtctccattccttccgtgtctgactatcgtaggaggagacgagtacgtaccacctactcctacgttcgggcgggacgacggtacggtagggttattagcgtacggtcgttacggtcgtccgttaggtactgacgacgaaacgaaaaccgggaacgggaaccgtacccgtatcctaccgtagtactacgtaggtcggtacnctacgtacgttaagggttagggtaacgggtccggaaccctacggtaacggtcgacggcgtgtaacgtacgacgtcggaggaactacgttacttccgactcctaccgtaccgtatacccgacgaccgtaccgtccgtagtacccgacggtaccgttaaggtaaccgtttacgtttaaccgaccttttaaaccgttacgttactaccgttaacccaaagggttaccgttaaccgtttaaacccggttcccccgttttacccgttacccggtttaacgttacccggggtttacccggggaaacgggggtaacccgggttaacgggtaaacgggttacgaaaaccggtttaaacgaaaaccgggttaaacccgttacggggttacggtacccggtaaccgttccggtaaaaccctccggttaacccgg

SEQ ID NO: 101681 - DNA, 793 bp, Homo sapiens
  misc_feature: GYAE6OF01ANVF8.15.71.G05.1.454.CMB.1.raw
  modified_base (247)..(247): a, c, t, g, unknown or other
  misc_feature (247)..(247): n is a, c, g, or t
tcagtctacgtagccacgaccggtgctcgatttagtgtcgtcgcaagagagagggggtcaggctggaactgaggagcaggtgggggcacttctccctactaacactctccccgctcagctcctggggctcctgctgctctggttcccaggttccagatgcgacatccagatgagccagtcctaccattccttccgtgtctgctatctaggtaggagacagacgtacaccatcaacgtttggtcgggngagtacgtagggtatagcagtcgtggtacgcctggtatcgagacaaggaaaccgagggaaaccgccccgtaaagccttccgtagacttactagtggtacactacgtcgtagggtttagggaaacgggtccggggtaaccctaaccggtaaacgggttcgacggtccgggacgtaggttaacggtacgttaccgtaggggtaaacctaaggttacttttaccgaaccttaccttaccaaccgtacgtactacggaccgtaccgtccgtacgtaccgtaacggtcccgtaaggtacggttacgttttacgtaaccttaaacctttaacggtttaacgtttacggtaaccgtaacggtaaccggttaaaccgtttaaaccgtttaccggttttacccccgtaaccgttaacccgttaccgggttcccgggtaaaccggggtaacggggtaaacccggtaaaggggttaccggtaaacgttaaaccggtaaaccgtaaaacggttaacggttacggtaacggtacccgtaacgtaccgtaaccgttaacg

SEQ ID NO: 101682 - DNA, 736 bp, Homo sapiens
  misc_feature: GYAE6OF01DX0ZT.15.71.G05.1.454.CMB.1.raw
  modified_base (248)..(248): a, c, t, g, unknown or other
  misc_feature (248)..(248): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagcctagtctcattcgttccgtgtctgcatctaggtaggagacgagtacgtccaaccatccgtacgttggtccgggngacgtcgagggttattacgcgtagtcgttaggttacgccgttaggtactacgacgaacgaacggaaaccggaacgggaaaccgtacccgtaagcctactaggtactcgttagtcggtacgacgtaacgttccgttaagggttaacgggtaacggttccggggtaccctaacggtaacggttacgacggtcgacgtaaggtagaaacgttcggacggtaacgtacgtttacgttaccgtacctaccgtacctaccgtacgtacgacgtaccgacgtccgtacggaccgcggtacgttacggtagtttactttacgtaacttaacctttagtacgttacgtacgaacgttacggtaccttaaccgttacccgttaccgttactaccggttaccggttacgggaccgggtaacggtaaccgtaggggttaaccacgttaacgaaaccgtaacggtacggttcggtaccggtactcccgtacgtacgttacg

SEQ ID NO: 101683 - DNA, 824 bp, Homo sapiens
  misc_feature: GYAE6OF01CP4WM.15.71.G05.1.454.CMB.1.raw
  modified_base (92)..(92): a, c, t, g, unknown or other
  misc_feature (92)..(92): n is a, c, g, or t
  modified_base (112)..(112): a, c, t, g, unknown or other
  misc_feature (112)..(112): n is a, c, g, or t
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
tcagtctacgtagccacgaccggtgctcgatttagtgtcgtcgcaagagagaggggtcaggctggaactgaggagcaggtgggggcacttcnccctctaacactctccccgntcagctcctggggctcctgctgctctggttcccaggttccagatgcgacatccagatgagccagtctccattctccgngtctgcactctgtaggngacngacgttcacctagtcacgttggccggngagtcagggtattagcgagtcgtaggttacgccgttggtaactccgaaggtaccaacggaaaaaccccggaggggtaaaaccgtacccccgttaagcccgtttaccgtacggtaacttcgtacgttacgggtagacctaacgtaccgtaaggtttaccgggtaaacggtccggggttacccaaaccggttaaagggttcccaacgggtaccgggtacgtaacggttacggttaacgtaccgggttacgggaaccgttaacggttactttacccgaccgtttcccgtaccgtaacccgtagtaccgtaaccggtacgtaaccggtacccggtttagacccggtaaccggttaccccgtaaggttaccgggttaactttttaccggaacgtttaaaccgtttaccgtttaagtttaccggttaacccgaaacggtaacgggtcccgttaaaccgttacccggttttaccctaccggttaccgttaccggtttccgggaccggttaaccgggtaaccgttaagggtcggttaaacttaaccggtaacctaaacggaacttcggtacggtccgtacgccttaccgtaccg

SEQ ID NO: 101684 - DNA, 852 bp, Homo sapiens
  misc_feature: GYAE6OF01C7B5A.15.71.G05.1.454.CMB.1.raw
  modified_base (98)..(98): a, c, t, g, unknown or other
  misc_feature (98)..(98): n is a, c, g, or t
  modified_base (113)..(113): a, c, t, g, unknown or other
  misc_feature (113)..(113): n is a, c, g, or t
  modified_base (601)..(601): a, c, t, g, unknown or other
  misc_feature (601)..(601): n is a, c, g, or t
tcagtctacgtagccacgaccggtgctcgatttagtgtcgtcgcaagagagagggggtcaggctggaactgaggagcaggtgggggcacttctccctntaacactctccccgntcagctcctggggctcctgctgctctcggttcccaggttccagatcgcgacactccagatgacgccgagtcctcctattcctttccgtgtctgctatctggtaggagacgaggtactaccaccacgtcctacgttcggtacggggcgaggtcgtaaggggttaattacggcgacggtcgttgggttacgtccgttgggtaatcgaacgaaccgaaacgggaaacccggtaaaggggaaaacccgtaccccgtaaaggcccttccgtagtagttaccggtaggtgggtaccgttacgaccgttacggttaacgggtttaacgggtaaaccgggttcccgggtaaccccgtaaacgggtttaaacgggttacgaaccgggtcgaacggtaacggtagaacggttcgggtaacgggtaacgtagtttaaccttacgttacccttaccgtacgtacccgttaatacccggacgtaaccggtacggtcgtacncccggtacgtaccgtttaacggtcgtttacgttttaaccgacgttttaaacctttaccgttatttacgggtaacccgtaacggtaaccggttacctaacgttttcccggttaactacgtttacccgttacgggtttaaccgggaccggggttaaagggacccggttaacggggtaagtaaaccgttaacggaaaaccggttaaaggttaacggttcgggtaacggtacctaaggaccccttacggttaacc

SEQ ID NO: 101685 - DNA, 772 bp, Homo sapiens
  misc_feature: GYAE6OF01C2B0Z.15.71.G05.1.454.CMB.1.raw
  modified_base (198)..(198): a, c, t, g, unknown or other
  misc_feature (198)..(198): n is a, c, g, or t
  modified_base (725)..(725): a, c, t, g, unknown or other
  misc_feature (725)..(725): n is a, c, g, or t
tcagtctacgtagccacgaccggtgctcgatttagtgtcgtcgcaagagagagggggtcaggctggaactgaggagcaggtgggggcacttctcccctctaacactctccccgctcagctcctggggctcctgctgctctggttcccaggttccagatcgcgacatccaagatgagtccagtctccaagttcttccgngtctgacaactctggtaaggaagaccaggtaatccaacctatctacgttcggtacgggcaggtcgtagggtattagcaagcgtaggttacgccgttaggtatacgaacggacaacggaaaaccgaacggggtaaacgaccccccgttaaagacccgttaccgtacggtaaacttacgttaaggtcgggttacgtaaccgtaccgttaacccggttaagggttttaacgggtaaaacggggtacccggggttaacccgtaaaccggtaacgggttaccgaacgggtccggaaacggtacggtagtaacgtcggtacgggtaacgtacgttaacttcctaacttacctaacctaacctataccgtaactacgtaacgactaacggccgtacgtaccgtaggtaaggtactttagtaacccgtaactttaacgtacttaagtaccaaacgttacggtacttaaaccgttccgtttacctacgttaccgtacgttcgggaaccgggtaggtaccggtaaacggtagttaanaaacgtaaccgtaaacggacttcgggtactacgaactactcgtaacg

SEQ ID NO: 101686 - DNA, 714 bp, Homo sapiens
  misc_feature: GYAE6OF01EVEIG.15.71.G05.1.454.CMB.1.raw
  modified_base (360)..(360): a, c, t, g, unknown or other
  misc_feature (360)..(360): n is a, c, g, or t
  modified_base (557)..(557): a, c, t, g, unknown or other
  misc_feature (557)..(557): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctcggttccctaggttccagatcgcgacatccagatgagccagtctcctatcttccgtgtctgcatcgtgtaggagacagacgtacacctatctacgttggtccggcgtagtcgaggttattagcaggtcgttaggttacgtccgttaggtatccgaagacaaacggaaaaccgaacgggaaacgccccgttaagccgttaccgtagtacttcgtaagtcggtnacctagtaccgtaggtttaacgggaacggtcgggtaacccacgtaacggtcgtaggccgtagtaggtagtagttcgagggtaactagttaacgttcctacgtacctaaccgtaccactacgtaacgacccgtacgaccgtagacccgacgtacccgttaggtacgtttacgtttacgaaactttaccgtttaacgtnttaaccgtacgaaacgtacgtaacctttaaccgttcccgtttaccgtccttaaccgtccggttacgggaccggtaaacgggtaccggtaaggttatacgtaactaaaccggtaaagtacgttacgggtcgtaacgtccctaacgttaacccgttacg

SEQ ID NO: 101687 - DNA, 642 bp, Homo sapiens
  misc_feature: GYAE6OF01BGB6W.15.71.G05.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
  modified_base (468)..(468): a, c, t, g, unknown or other
  misc_feature (468)..(468): n is a, c, g, or t
  modified_base (554)..(554): a, c, t, g, unknown or other
  misc_feature (554)..(554): n is a, c, g, or t
tcagtctacgtagccacgaccggtgctcgatttagtgtcgtcgcaagagagagggggtcaggctggaactgaggagcgagggtgggggcacttctccctctaacactctccccgctcagctcctggggctcctgctgctctgtcccaggttccagatgcgacaatccagatgagtcagtcctccattcgttccgngtctgcatctggagacgacagtcgtcactanctacgttcggcggggcacggtagtaaggggttaattaccgngtacggcgtttagggttacacgttggtntaccagaccgttaaacgaacggaacgggaaaccnccctaagctacgagtacncgtaatcggatcaagtcgtaggttaacggaacggtccgtaccaacgtaagtcgacggtcacggtagttnaacgtacggtaggacctagtatttacccgatactacgacaactgaacccgtnaccggtcctaggctacgcgtaagtcggttattgaaacgactttaactttacgaacaacgtaacgtacttaaaccgttcttacccgnttaacccgtaggtccgggaggtaacgaacgtaggtacagtttaaccaagtaaacgcggtttgacggaaccttggaaaccctgttaccg

SEQ ID NO: 101688 - DNA, 976 bp, Homo sapiens
  misc_feature: GYAE6OF01E3R3M.15.71.G05.1.454.CMB.1.raw
  modified_base (157)..(157): a, c, t, g, unknown or other
  misc_feature (157)..(157): n is a, c, g, or t
tcagtctacgtagccacgaccggtgctcgatttagtgtcgtcgcaagagagagggggtcaggctggaactgaggagcaggtgggggcacttctccctctaacactctcccgctcagctccgtgggctcctgctgctcgtcggttcccaggttccagntgcgacactccagatgagccagtcctccattcgttccgtgttctcgtctagttcgtaggtaggacgacgaaggtctaccaccgtatccgttaccgttcggtccggggacgtacggtacgtaaggggttaagttacggacgtaacggttccgttttagggttaccgtaccggtttacgggttaactaccggaacggtaaccgaaaaccggtaaaaacccgggaaacggggtaaaccccgtaaccccgttaaacggtcccgttaccgtagttaccggttacgtttacgggtaccggtacgtacccttaacggttaaccggttaagggtttaacgggtaaaccggtttcccggggaaaccctaaacgggttacgttccgggaaacgtccggtaactaggtaacggtacgtacgggttacgaacggtaacttacgttaccgtacctaacgtacctaccgaacgtacgaccggttactacccggtacgtacccgtaccggtaaccgggttacttaacgggttaacgttttaaacggttttaacccggttaaccctttaaacccgggttttaagtttaaccgttaacccgggtaaaaccgttaaccgggtttaccgtaaaaccgttttacccgtttacccggttttaacccccgtttcgttaaccccggtttaccggggttaccgggaaaccggggtttaacccgtaaagggggttaaaccgttaacggttaaaccggttaaaaacccgttaaacccggggttaaagtacccggggttacgtttaaaccgaccgggttaaccctaaccccgttacgttttaaccg

SEQ ID NO: 101689 - DNA, 797 bp, Homo sapiens
  misc_feature: GYAE6OF01DR6K1.15.71.G05.1.454.CMB.1.raw
  modified_base (476)..(476): a, c, t, g, unknown or other
  misc_feature (476)..(476): n is a, c, g, or t
tcagtctacgtagccacgaccggtgctcgatttagtgtcgtcgcaagagagagggggtcaggctggaactgaggagcagggtgggggcacttctccctctaacactcctccccgctcagctccgtggggctcctgctgctctggttcccaggttccagatgcgacatcagatgagccagtcctccagttccttccgtgtctcgcatctaggaggacacagactcaacatcacgtttggccgggcgtaagtcggaaggttacttagaccgaggtcgtggttaacgccgttaggttacacgagacaaacgaaaaccggaagggaaaccgtaccccgtaagtcctacccgtagacgttacgttagtcggttacactaacgttaccggtaagttacgggtaaaacgggttccgggtaaccctaaccgtaaagggttacgaggtaccggacgtaaggtaagaacgttacggaccgggtaanacggttacgttttaccaaccgttacctacctaacgacgttacgaacgtacgacgtcccgacggtacgtacggtaccgttaggttaacgggtttactttacgaaacccgtttaactttaacgttaaccggtttacgttaaaccgaaaccggtacgggttaaacccttaaccgtttaaccgtttccccgtacgttacccttaacgggttaccgggtacggggaaacggttaaacccgggtaacgggttaagggtaactaaacgttaaccggaaaacggttacccgtacggtaccgggtatacccggaactaacccgtttaacg

SEQ ID NO: 101690 - DNA, 677 bp, Homo sapiens
  misc_feature: GYAE6OF01BY9YV.15.71.G05.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatcgtggtaggagacagacgtcaccntctacgttggcgggngagtcgagggttattagcgagtcgttaggttacgccgttaggtactcgacgacgaacggaaaaccggacggggaaaccgtccccgtaagtcctccgtagtacttacgtggtggtcgactacgttacgtaggtttacgggaacggtccgggtacccacggtaagtcgacggtcggcgtaggtagaacgttcgaagggtactagttacttaccgacttacctacctactatacgacgacgtacgccgtagaccgtacgtcggtaggtacgtttacgttacgtaacctttaagttacttagtaccgtaacgaacgtacgtaccttaaccgttccttccgtacgttacgtaccgggttacggacgggtaaccggtacggtaacgggttagtaaacgttccgaaacggtaacgtacggttgacggtaccaccgtcacgttaccg

SEQ ID NO: 101691 - DNA, 883 bp, Homo sapiens
  misc_feature: GYAE6OF01AZRTQ.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctcccgctcagctcctgggctcctgctgctcgtcggttaccgtacggttccgagagtcgacgtaaccactccgagtagtacggacgtccgtacggttcctacctacttccgtttccgtcgtcgtacgtacgtacgttcgtagggtaacggacgaacgtacgtacgtacctaccgtaacgttaccgttacggttccgggcgggtacggtacggttacggtaacgggttacgtttacgaccggtaggttacggtttacgggtccgttacggttacggtacctacgaaccggaactaaacgggaaaaccggaccgggtaaaaccgtccccgtaacgttccgaacttacgtacgtacgttcggtggtactacgttaacgttacggttaagggttaacgggacgggttccggtaacctaaggtacgtaggtacggcgtacgtagtacgtaacggtcggaggttactagtttacctaccgtacgtacctaccaacgttaccgacgaaccgggtccctaacggtaccttaccggaacggttacccttaacgggttacggtaagttttttaaccggaacttaaaccggtttaacgtttacgtaaccgtttaccggaacttaaccggtaccggttaaccttttaccggtttaccgttacccttacggttaccggttaccggggttaaccgggaaccgggtaaacgtaacgggttacggtaacttaacccggtaaaacgacgtaccgtacggttagtaccgtaccggtactaccgtgtttaacccgg

SEQ ID NO: 101692 - DNA, 842 bp, Homo sapiens
  misc_feature: GYAE6OF01BM5Q7.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctgggctcctgctgtctttggtcccaggttccagatgcgacatccagatgacgcctagtcctcctagttccttccgtcgtctgtcagttccgtaggtaaggacgacagtacgtccactactctacgttcggtaccgggcgtacggtcggaaggttatacgctacgtcgttcggttacgcccgttaggtactcgaacggtaccgaaaacggaaaaccgtacggggaaaccctaccccgttaacgtcccgttccgttacgtacgttacgtaggtcggtacgtacgtacgttaacgtacgggtttaaggaaccgggtccgggtaccccaacgtaccggttggaccggtacggactacgggttaactaaccgttcgggtaacgggtaacttaccggttacttttacccgtacccgtttaccaacggttaacccttacgtaccgtaacgggtcccacggtcccgttacgaccgttacgtaccggttagggttaacgttacgtttaaccgtacccgttaacttacgtttaaccgtacgtaaccgtaaacggttccgttaaaccttacccggtttaccgttttcccccttaaggtccccggtttacggttaaccggggtcggttaaacccgggtaaccggtaacggtttcgtaaaccccgtttggaacccgttaaacggttacccgttcggtacggtccctaaacggccccttaaagttccgttacccg

SEQ ID NO: 101693 - DNA, 687 bp, Homo sapiens
  misc_feature: GYAE6OF01A3T67.15.71.G05.1.454.CMB.1.raw
  modified_base (267)..(267): a, c, t, g, unknown or other
  misc_feature (267)..(267): n is a, c, g, or t
  modified_base (334)..(334): a, c, t, g, unknown or other
  misc_feature (334)..(334): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctcggttcccaggttccagatgcgacatccagatgagccagtctccattccttccgtgtctgcatctgaggagacagagtcaccatctacgttggtcgggacagtcgagggtattagcagtctaggttacncgtaggtatcgagcaagaaaccgacgggaaacgaccctaagcctaccgtagactactagtcggtacnctacgtaccgtaggtttacgggaaacggtccggggtaccccaacgtaacgggttacgaggaccgtcgaacggtacgtacgtacggcggtaactaggtactttaccgaccttcctaccaaccgtactaccgaacgacgtacgccgtacgaccgacgtcggttaggtacggttactttcggtaaacccttaacgtttaagtttaacttccgaactaaccgtaaccggttacttaaccgttacccgtttccctaacgttaccgttaacggttcgggaccgggaacggtaaccgtaagggtaggaacttagaacccgaaacggttaccgtaggtaccgtactaccgacttccgtacg

SEQ ID NO: 101694 - DNA, 753 bp, Homo sapiens
  misc_feature: GYAE6OF01AQ7RB.15.71.G05.1.454.CMB.1.raw
  modified_base (113)..(113): a, c, t, g, unknown or other
  misc_feature (113)..(113): n is a, c, g, or t
  modified_base (211)..(211): a, c, t, g, unknown or other
  misc_feature (211)..(211): n is a, c, g, or t
tcagtctacgtagccacgaccggtgctcgatttagtgtcgtcgcaagagagagggggtcaggctggaactgaggagcaggtgggggcacttctccctctaacactctccccgntcagctcctggggctcctgctgctctggttcccaggttccagatgcgacatccagatagagccagtctccatccttccgtgtctgcatcgtgtagganacagatccaactatctacttcggccgggagacggttcgagggtattacgcgtagtcgttggtagtccgttggtactcgaagtacgaacggaaaaccgtaacgggaaaccgtcccctaaggtccttaccgtaggtaactccgtaagttcgggtactaccgtacggtacgttaagggtttaacgggaacgggtttacccggtaacccgtaaccggtaaacggttaccggacgggtccggaagttaagggttacgtaacggtacgggtacgggtaaaccgtttaagttcccttaaccaccgttaccctaaccccgtataaccgtaccgtaggtacccgtaacgtcccgttaccggacgtaccgtaaccgtaggtacgttattaccggaacttaacgttaattacgttacgaacgtacgtacgttaaccgttaccgttaccttacctcgtaaccggttccgtacgggaaccggtaaaccgtacgggtacgttaagaactaccgtaaaaccggtcgtacgtaggctacccgttacgactaacgtccg

SEQ ID NO: 101695 - DNA, 768 bp, Homo sapiens
  misc_feature: GYAE6OF01DQKN1.15.71.G05.1.454.CMB.1.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
tcagtctacgtagccacgaccggtgctcgatttagtgtcgtcgcaagagagagggggtcaggctggaactgaggagcaggtgggggcacttctccctctaacactctccccatcagctcctgggctcctgctgctctcggttccccaggttccagatgcgacatccagatggacgccagtctccagttcctttccgngtcctgctatcgtgtaggagacagagtccacatctacgtggtcgggngagtcgagggttatagnagtcgtggttagtccgttaggtatcgagacgaaacgtaaaccgacgggaaaaccgtcccgttaaacgtcgttaccgtagtacttaccgtagttggtacgtcctagttacccggtaaggttttacgggaaacggttccggggtaaccccgtaaacgaacgggtttcgaacggtccggtacgtaaaggttcgtaacggtcggtaagggtaaccgtaagttacctttacaccgtttccgaaccgtaccgaagttccgaagtaccgtaccgtcctacgacccgtacgtaccggttaggtaacggtttacgttttaccgaacctttaacgtttaactttacgtacgtacccgtaaacgtcgtttaccttaaccgttaaccccgtttccctaccggttacgttacccggtttcgggaacccggtaacgggaaccgttaacgggtaagtaacgtaacccgttaaacggaaacccggttacgttaggtacccgagtccgtaaccgtacggttacc

SEQ ID NO: 101696 - DNA, 672 bp, Homo sapiens
  misc_feature: GYAE6OF01CKNLP.15.71.G05.1.454.CMB.1.raw
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
tcagtctacgtagccacgaccggtgctcgatttagtgtcgtcgcaagagagagggggtcaggctggaactgaggagcagggtgggggcacttctccctctaacactcctccccgctcagctccgtgggctcctgctgctctcgttccagttcagatgcacgatccagatgacgcgatctcatcttcgtgtctgcatcgngtaggagacgtagataccaccatacacgttggacggacgagtcgaggtacttagcagtcgtaggttanccgttaggaactacgacgacgtaacggaaaccgtagggaaaccacccttaagccctactagaacttcgtagcggtacgctacgttcgtaaggtttagggaaacggttccggacccaagttaacgtcgacggtggacaggtacgtaattcgaacgggtacgagttaagttaccactacgtaccgaacagtacgacgacgtacgtacgtacgactacggtccgtaaggacgtttacgtttacgaacttaacttaacgtttattaacggactaacggtacgtaccgttaaacgtttccgttcctacgttccgaacgggttaccggtacgggtaacgaacggtaaggtttacgaacgttaacggtaaccaaacggtacttacggacgttacaccggtacttaaccggta

SEQ ID NO: 101697 - DNA, 921 bp, Homo sapiens
  misc_feature: GYAE6OF01BQQY6.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgcatcgtggtaggagacagacgtcaccatctacgttggcgggcgagtcgaagggttatacgcagtcgtggttacgccgttaggtactacgagaccgaacggaaaaccgaaggggtaaaccaccccgttaaagtccgttaccgtacggtaacttacgttaggtcgggtactacgtaacgttaccggttaaggttttaacggggaaacgggttccggggttaaccccaaccggttaaacgggtttcccgaacgggtccgggtacgtaacggttaacggtaacgttacgggtacgggaacgttacggttactttacccgtaccgttacccttaaccgtaacccgtaacgtaccgtaacggacccgtaaccgtcccgtacggacccgtaccggtacccggttaagggttaacggttttaccgttttaaccggtaaccttttaaacccgttttaacgtttaacggtttacgttaacccgtaaaccggttaaccggttaacccgttttaaaccggtttaccccgttttaccccgttacccgtttacccggtttaacccggggtttttacccgggggaacccgggggttaaaaccgggggttaaaccgggttaacggggttaaccgggttaaacgtttaaaccccggtaaaccggttaaaaaccgggtttaaccggtttacggggttacccggttaccggttacccgtaacccgttaacccggtttaaccgg

SEQ ID NO: 101698 - DNA, 856 bp, Homo sapiens
  misc_feature: GYAE6OF01B9G9V.15.71.G05.1.454.CMB.1.raw
  modified_base (221)..(221): a, c, t, g, unknown or other
  misc_feature (221)..(221): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctcggttcccaggttccagatgcgacagtccagatgacgccagtcctcctattccttccggtgtctgctagtcgtaggtagganaacgaggtactccaaccgtacttaccgtacggtttgggccggggacgtacggttacggtaaggggttattaacggccgtaagggttcggtttaacgggttaccggaccgtttacggtacgtaccgaacgggaactaaaaaccggggaaaacccgggtaaaggggaaaccccgtaccccggttaagtccccgttaacgtagggtactttaccggttaggccggggtacctacctaaggtttacccggttaagggtttaacgggaaacgggttccccggtaaccctaacggttacggtcggaacggcccgtttaaggaacgttaggaacgttcggaaagggttacctaacgtttaccttcccgaaccgttccgtacccaaccgttagaacccggtagttaaccccgaccggtacggtacgtaccgtaccggttaaccggttaggttaaccttttacggtacttaaccgtttacgtttaaacttgttaacccggaactaacgggtcctttaacgttacccgttcccgtttccgtacgtccggttacccggggtaccggagggtaaccggttaccggtaaggttacgtacgtaaacgaacccgtaaagggttggtcgtaggcccttaagccgttagtcg

SEQ ID NO: 101699 - DNA, 841 bp, Homo sapiens
  misc_feature: GYAE6OF01CDJZS.15.71.G05.1.454.CMB.1.raw
  modified_base (99)..(99): a, c, t, g, unknown or other
  misc_feature (99)..(99): n is a, c, g, or t
  modified_base (149)..(149): a, c, t, g, unknown or other
  misc_feature (149)..(149): n is a, c, g, or t
  modified_base (327)..(327): a, c, t, g, unknown or other
  misc_feature (327)..(327): n is a, c, g, or t
  modified_base (618)..(618): a, c, t, g, unknown or other
  misc_feature (618)..(618): n is a, c, g, or t
  modified_base (625)..(625): a, c, t, g, unknown or other
  misc_feature (625)..(625): n is a, c, g, or t
tcagtctacgtagccacgaccggtgctcgatttagtgtcgtcgcaagagagaggggtcaggctggaactgaggagcaggtgggcacttctcctataacnctcctcccgctcagctccgtgggctacctgctgtcctcgtacggttcccnggttaccagtactcgcgtacctacgttaccagtacgtcggacgtaccgtagtcctaccgttacgttccctttacgggtctacgttcacctatttaccggtaggtagggaactaccgaggtacctacccacctagttccgtacgtttcgggaccggtcgtaaaggttcgtaaagggttnttacgacgtcgtttaccgggttacggttacgtaccggttgtaacgttcgaacgaaccggtaaaaccggaaaccggaacgggttaaaccccgtacccgttaaccgccgttaccgtacgtacggttccgtaggtacctccgtaccttacggttaacggttagggttaaccgggtacccggtaccccgttaaccgtaaacggttaccggacgaccggtacgtaacgtacggtaactacgggtaccggtacgtaacgttcctttattaccccgacgtaccttaccgaccgttacncgtaacncgacgtaccgtcgacgtaaccgtggtaagtttcggtaactttaccgtatttaccgtaattacgttacgaacttacgtaacccgtacgtttaaccttccgttacccttacgacctttacggtaccgttacggggaaacgttcccgggaaaggtttacggtaactacggttaaaccacgtttaaaccggtccgttagaccgttaccctagcccgttac

SEQ ID NO: 101700 - DNA, 772 bp, Homo sapiens
  misc_feature: GYAE6OF01BOSPR.15.71.G05.1.454.CMB.1.raw
  modified_base (728)..(728): a, c, t, g, unknown or other
  misc_feature (728)..(728): n is a, c, g, or t
  modified_base (734)..(734): a, c, t, g, unknown or other
  misc_feature (734)..(734): n is a, c, g, or t
  modified_base (762)..(762): a, c, t, g, unknown or other
  misc_feature (762)..(762): n is a, c, g, or t
tcagtctacgtagccacgaccggtgctcgatttagtgtcgtcgcaagagagagggggtcagggctggaactgaggagcaggtgggggcacttctccctctaacactctcccgctcagctcctggggctcctgctgctctggttccaggttccagatgcgacatccagatgacgcctagtctcctattccttccgtgtcctgtactatcgtggtaaggagaacgagtacgtaccaccgtactaccgtacggttcgggtaccgggtacggtacggtacggtaaggggttactttacgaccgtaggtccggtttggttaacgtccgttagggtacctcgaacggacgaaacggtaaaccgggaacgggtaaaaccctcccgtaaacggttcctaccgtagtaccgttacgttaggtacggtcgtacctaccgtttaacggtaagggtttaacggggtaaaccggttcccggggtaacccctaacgggttaacggttaccgggacggtacgggttacctaaggggttaacgtacggttacgggtaaccgggtaacgttaagtttacccgtttaccgtaacctacccgtaacgtaaccctacgtaacgacgtacggtacctcgtacgaccgtacgtacgttacggtacgtttactacgtaacttatttacgtatcgactagactaccttacgttctctacgtcgttacggacggacggtaaggacgtaggtanaacttnaaacgacggttacgtcggacgtagtacncgtacgttac

SEQ ID NO: 101701 - DNA, 768 bp, Homo sapiens
  misc_feature: GYAE6OF01CE64R.15.71.G05.1.454.CMB.1.raw
tcagtctacgtagccacgaccggtgctcgatttagtgtcgtcgcaagagagaggggtcaggctggaactgaggagcaggtggggcactttcctccctctaacactctccccgctcagctccgtgggcctcctgctgcttctcggttcccaggttccagatgcgacatccagatgacgtcctagtcctccattcgttccgtgtctgtccattcgtaggtaggagacgaggacgtcaacattccgtacgttggtacgggacgtacggtaggtaacgggttattaacggcgtacggtcgttagggttacgtccgttaggtaactcgaacggaccgtaaaggtaaaacccggaacgggtaaacccgcccgtttaaaacggcctttaccgtagtaacttaccggtagtacggtacgtaccctacggttacccgttaagggttttacccgggaaaggtttccgggtaacccctaaacggttacggggttcccgtaaggaccggtacgtaacggttggtaaaccgtttccgggaaggaacgtttacgtaccggttttacaacccgttccgtacctaacgtacggttacgacgtacgtaccgtaccgtacgtacggaccgtacgtacggtacgtactttacgtacgttaacttaacgtacgttcgtaacaccgttagtaccgttaacgttcttacccgtacgtaccgttacggtcggacggtacgaaccgtagtcgataccgtagaaccgtgtacgtacgattcgtactccggtac

SEQ ID NO: 101702 - DNA, 701 bp, Homo sapiens
  misc_feature: GYAE6OF01CG1HW.15.71.G05.1.454.CMB.1.raw
  modified_base (115)..(115): a, c, t, g, unknown or other
  misc_feature (115)..(115): n is a, c, g, or t
  modified_base (165)..(165): a, c, t, g, unknown or other
  misc_feature (165)..(165): n is a, c, g, or t
  modified_base (210)..(210): a, c, t, g, unknown or other
  misc_feature (210)..(210): n is a, c, g, or t
  modified_base (617)..(617): a, c, t, g, unknown or other
  misc_feature (617)..(617): n is a, c, g, or t
  modified_base (651)..(651): a, c, t, g, unknown or other
  misc_feature (651)..(651): n is a, c, g, or t
  modified_base (684)..(684): a, c, t, g, unknown or other
  misc_feature (684)..(684): n is a, c, g, or t
tcagtctacgtagccacgaccggtgctcgatttagtgtcgtcgcaagagagagggggtcaggctggaactgaggagcaggtggggcacttcctccctactaacactcctccccgntcagctccgtgggctctgctgctcgtcgtccaggttcagatgacactacncagtagtagacgccagtcctcctagttccgttcgtgtctcgactntcgtagaggacgacgtagacgtccaacgtactccgtacgttcggaccgggacgtaggtacggtaggtactcggacgtaaggttcggtcggtacgacgttagactcgaagacgtaaacggaagtaacgggaaccctccgaactacctgtaacgtacttagtgacggtacttcacgtttaggtaacggttaagggtacgtacccggtaaccaaggttaggacaggcgtaacgtagtacgtaagtcgaagggtactacgtactacgtctaacgtccaacacgagtaacgcgtaaacgttcgacgtacgtacggcgttaaggtaaactttacgtacccaagtttaactaactagggttacaaacgtaccgtaaccttacgttaaccttttccgaacgtttccggtaacggnggttaccccggaaagggacttaacggaggttaanacttaaacggaccgtaacgttgggctaccgtancaacccgtttattcccg

SEQ ID NO: 101703 - DNA, 501 bp, Homo sapiens
  misc_feature: GYAE6OF02H5C1Y.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacaaggttcagcggcagtgaatctgggacagatttcactctcaccatcagcagcctgcagcctgaggtattttgctaacttactattgtcaacaggctaacagtttccctcttcactttcggcggagggaccgaaggtggatatacaacgactgtggctgcactac

SEQ ID NO: 101704 - DNA, 502 bp, Homo sapiens
  misc_feature: GYAE6OF02IGGG1.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacaaggttcagcggcagtgaatctgggacagatttcactctcaccatcagcagcctgcagcctgaggattttgctaacttactattgtacaacaggctaacacgttttccctctctactttcggcggagggaccaaggtggatatcaaacgactgtggctgcactac

SEQ ID NO: 101705 - DNA, 509 bp, Homo sapiens
  misc_feature: GYAE6OF02FPDSJ.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacaaggttcagcggcagtgaatctgggacagatttcactctcaccatcagcagcctgcagcctgaggtattttgctaactttactattgtacaacaggactaactacgtttccctctctactttcggcggacgggaccgaaggtggatatacaaacgactggtggctgcactac

SEQ ID NO: 101706 - DNA, 523 bp, Homo sapiens
  misc_feature: GYAE6OF02I02V0.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccgaaggttcagcggcagtgaatcgtgggacagatttcactctcaccatcagcagcctgccagcctgaggtattttgactaacttactattgtacaacaggacttaactacgtttccctcttctacgtttcggcggacgggaccgaagggtaggattaatacaaacgaactggtaggctgccactac

SEQ ID NO: 101707 - DNA, 593 bp, Homo sapiens
  misc_feature: GYAE6OF02H71WI.15.71.G05.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagtctacgtagccacgaccggtgctcgatttagtgtcgtcgcaagagagaggggtcgaggctggaactgaggagcaggtggggcgaattctcctctaacactctccccgctcagctcctggggctcctgctgctctggttcccaggttccagatgcgacatccagatgagccagtctccatcttccgtgtctgcatctgtagganacagagttcaccatcgacttgtcgggcagtcagggtattagcagctggtagcctggtatcagcagaaaccagggaaagtcccctaagctacctgatctatggtncaatccagtttggaaatggggtcccacgaagttcagcggcagtgatctgggacagattttcgactctcaccataccagcaagcctagcaggccttggaaggtatttttcggactaacgttaaccttaagtttgtacgaacaagggtcctaaactaacgttttcccctacttccgtaaccttttcgggaccggtaaggggtacccgaaagggtttacggaattacgttaccgaaaacggtaaccgtacggtttacgggaccgttaggtacccgaactaaccgg

SEQ ID NO: 101708 - DNA, 510 bp, Homo sapiens
  misc_feature: GYAE6OF02IV25O.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgcgggcgagtcagggtattagcagctggttagcctggtatcagcagaaaccagggaaagcccctaagctcctgatctatggtgcatccagttggaaagtggggtccacaaggttcagcggcagtgaatctgggacagatttcactctcaccatcagcagcctgcagcctgaggattttgctaactttactattgtacaacaggtactaacacgttttccctctacacgtttcggcggagggtaccgaagggtggatacgtcaaacgactggtggctcgcactac

SEQ ID NO: 101709 - DNA, 503 bp, Homo sapiens
  misc_feature: GYAE6OF02GWIH9.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggtattttgctaacttactattgtacaacaggactaacagtttccctcttcactttcggcgagggaccaaggtggatatacaacgactggtggctgcactac

SEQ ID NO: 101710 - DNA, 562 bp, Homo sapiens
  misc_feature: GYAE6OF02G9QDC.15.71.G05.1.454.CMB.1.raw
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccagggaaacncccctaagctcctgatctatggtncatccagtttggaaagtcggggtacccacgaaggttcaggcggcagtgaatcgtagggacagtatttcactctcaccatcagcagcctgcagcctagaggtattttcgactaaacttactatttcgtacaacgtacggacttaactacgtttcccctactccgtacgtttccggacggtaacgggtaccgtaagggttacgtaataactaacgaaacgtacttggtacggacttacggacctaccgtacg

SEQ ID NO: 101711 - DNA, 538 bp, Homo sapiens
  misc_feature: GYAE6OF02GKPJ5.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtcggggtcccacaggttcagcggcagtgaatctagggacagatttcactctcaccatcagcagcctgcagcctgaggtattttgactaactttactattgtactaacgagacttaacctacgtttcccctcttcctacgtttccgggacggtaacgggaccgtaagggtacgtataatacgaaaccgacgttcggtacggactgccactacg

SEQ ID NO: 101712 - DNA, 520 bp, Homo sapiens
  misc_feature: GYAE6OF02JGHSX.15.71.G05.1.454.CMB.1.raw
  modified_base (351)..(351): a, c, t, g, unknown or other
  misc_feature (351)..(351): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatcctagtttggaaagtggggtcccacaaggttcagcggnagtgaatcgtgggacagatttcactctcaccatcagcagcctgcagcctgaggtattttcgctaacttatattgtacaacagactaactactttcccttctctacgttcggtcggacgggaccgaaggtaggtactatacgaacgtaacgtcgtggtctcgacactacg

SEQ ID NO: 101713 - DNA, 566 bp, Homo sapiens
  misc_feature: GYAE6OF02HUHM2.15.71.G05.1.454.CMB.1.raw
  modified_base (286)..(286): a, c, t, g, unknown or other
  misc_feature (286)..(286): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaancccctaagctcctgatctatggtgcatccagtttggaaagtcggggtcccacgaaggttcagcggcagtgaatctgggacagatttcactctcacatcagcagcctgccagcctggaggtattttgactaactttactattgtacaacgagtacttaactacgttttccctcttaccgtaccgtttccgggaccgggtacgggaacccgtaagggttacggtaattaacgtaaccgtaaacggtaacgttaggtacggtacgtacggacctaaccgtacg

SEQ ID NO: 101714 - DNA, 548 bp, Homo sapiens
  misc_feature: GYAE6OF02F5FXX.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatcctagtttggaaagtcggggtacccacgaaggttcagcggcagtgaatcgtagggacagtatttcactctcaccatcagcagcctgccagcctgagtattttgctaacttactattgtacaacgacggactaacgtacgtttccctacttcctacgtttcggcggtaacgggaaccgtaaggtacggaattaacgtacgaaacgaacgttggtacggtactcggtaccacgtacg

SEQ ID NO: 101715 - DNA, 577 bp, Homo sapiens
  misc_feature: GYAE6OF02I0K4E.15.71.G05.1.454.CMB.1.raw
  modified_base (285)..(285): a, c, t, g, unknown or other
  misc_feature (285)..(285): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgcgggcagtcagggtattagcagctggttagcctggtatcagcagaaaccagggaaacnccctaagctacctgatctatggtgcatcctaggtttaggaaagtggggtacccacgaaaggttcagcggtcagtgaatcgtagggacagtatttcactctacacatcagcagcctgcagcctgagtatttgactaacttactattgtacaacgagtaccttaaacgtaccgttttccctacttacctaccgttttcgggacgggtaacgggtaacccgtaaagggttacggaacttaacgtaaccgtaaacggaacgttcggtacggtaccgtacggtaccgtaccctaacg

SEQ ID NO: 101716 - DNA, 599 bp, Homo sapiens
  misc_feature: GYAE6OF02FPULR.15.71.G05.1.454.CMB.1.raw
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagagtcaccatcacttggtcgggcgagtcgagggtattagcagctggttagcctggtatcagcaagaaaccgagggaaacgcccctaagcctcctagactctagtggtgacactaccgtaggtttagggaaaacggttcggggtaccccaacgtaaggttcgaggcggcgagtgaatcgtgggacagtactttcactctacacctatcagcacgcctgcagcctagagttatttgactaacttacttattcgtacaacgaggtactaacgtacgtttccctactaccgttacgtttccgggacgggtaacgggacccgtaaagggtacggtaacttaacgtaaccgtaaaacggtacgttcggtacggccttacggaccctaccgtaac

SEQ ID NO: 101717 - DNA, 508 bp, Homo sapiens
  misc_feature: GYAE6OF02JH08C.15.71.G05.1.454.CMB.1.raw
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (435)..(435): a, c, t, g, unknown or other
  misc_feature (435)..(435): n is a, c, g, or t
  modified_base (498)..(498): a, c, t, g, unknown or other
  misc_feature (498)..(498): n is a, c, g, or t
tcagtctacgtagccacgaccggtgctcgatttagtgtcgtcgcaagagagagggggtcgaggctggaactgaggagcaggtgggggcgacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacgaaggttcagcggcagtgaatcgtggacngatttcactcncaccatcagcagcctgcagccgtgaggtatttcgactaacttactattgtcaacgngactaactacgttccctctctactttcggcgaggacgaaggtgatatcgaacgactaggtcgntcgcacgtac

SEQ ID NO: 101718 - DNA, 532 bp, Homo sapiens
  misc_feature: GYAE6OF02I5NGS.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatcctagtttggaagtcggggtcccacgaaggttcagcggcagtgaatcgtgggacagtatttcactctaccaccatcagcacgctgcagcctgagtatttcgactaacttactattgtacaacgtagtacctaactcgtttccctcttactacgtttcggacggtacgggtaccgaagggtagtataactacgaacgtacgtgtggactcgacactacg

SEQ ID NO: 101719 - DNA, 554 bp, Homo sapiens
  misc_feature: GYAE6OF02F6NZB.15.71.G05.1.454.CMB.1.raw
  modified_base (396)..(396): a, c, t, g, unknown or other
  misc_feature (396)..(396): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccagggaaacgcccctaagctcctgatctatggtgcatccaggtttaggaaaggtcggggtacccaacgaaggttcagcggcagtgaatcgtagggacagtatttcactctcacatcancagcctgcagcctgagtatttgactaactttactattcgacaacgtacggtactaacgtcgtttaccctcgttacctacgtttcggacgggtaacgggaccgtaagggtagaactaacgtacgaaacgtacgttcggtacgctacgacctaccgtacg

SEQ ID NO: 101720 - DNA, 532 bp, Homo sapiens
  misc_feature: GYAE6OF02HMG15.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaaagtggggtacccacgaaggttcagcggcagtgaatcgtgggacagtatttcactctcaccatcagcagcctgcagcctgaggtattttgactaactttacttattgtacaacaggactaactacgttttccctcttactaccgtttcggacggacgggaccgtaagggtggaatagtaccaaacgtacgtggtcggctgacactacg

SEQ ID NO: 101721 - DNA, 582 bp, Homo sapiens
  misc_feature: GYAE6OF02GM25G.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccgagggaaacgcccctaagctcctgatctatggtgcatcctagttggaaaggtcggggtacccacgaaggttcagcggcagtgaatcgtgggacagtactttcactctcacatcagcagcctgcagctgagtatttcgactaacttactattcgactaacgacgtacttaacgtacgttttaccctcgttaccgtacgttttaccgggacggtaacggggtaacccgtaaaggggtacgggtaacttaacgtaaccgtaaaacggtaaccgttcggtacggtaccgttacggacctaccgtaacg

SEQ ID NO: 101722 - DNA, 552 bp, Homo sapiens
  misc_feature: GYAE6OF02H4EBG.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaaccagggaaacgcccctaagctcctgatctatggtgcatccagtttggaaagtggggtcccacaaggttcagcggcagtgaatcgtgggacagattttcacttctcaccatcagcagcctgcagcctgaggtattttgactaacttacttattcgtacaacgaggtacttaacgttacgttttccctcttaccgtacgttttccgggacgggtaacgggtaccgtaaaggggttcgaattaactacgaaacgtacgtggtcggcgtagtccactac

SEQ ID NO: 101723 - DNA, 545 bp, Homo sapiens
  misc_feature: GYAE6OF02H1MRH.15.71.G05.1.454.CMB.1.raw
  modified_base (309)..(309): a, c, t, g, unknown or other
  misc_feature (309)..(309): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccaggaaagcccctaagctcctgatctatggtncatccagtttggaaagtggggtcccacgaaggttcagcggacagtgaatctgggacagatttcactctcaccatcagcagcctgcacgcctgaggattttgctaactactattgtacacaggcttaacncgtttccctntcctaacgttttcggaccggtacggggacccgaagggttaggaacgtaacgttactaaaacggaacgttggtggtacctacggtaccaccgtaaccg

SEQ ID NO: 101724 - DNA, 549 bp, Homo sapiens
  misc_feature: GYAE6OF02JHMGZ.15.71.G05.1.454.CMB.1.raw
  modified_base (289)..(289): a, c, t, g, unknown or other
  misc_feature (289)..(289): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccgagggaaacnccctaagctcctgatctagtggtgctatcctaggtttaggaaaggtcggggtacccaacgtaagggttcaggtcggacaggtgaatcgtagggacagtatttcactctcacatcagcagcctgacacgctgagtatttgactaacttatagttagtacaacgagtacttaactcgtttcctacttctacgtttcggacggtaacggaccgtaaggtagtaatacgtacgaaacgtacgttcggtgactacgtacactacg

SEQ ID NO: 101725 - DNA, 514 bp, Homo sapiens
  misc_feature: GYAE6OF02JAA1N.15.71.G05.1.454.CMB.1.raw
  modified_base (436)..(436): a, c, t, g, unknown or other
  misc_feature (436)..(436): n is a, c, g, or t
  modified_base (487)..(487): a, c, t, g, unknown or other
  misc_feature (487)..(487): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtcggggtccacaaggttcagcggcagtgaatcgtgggacaggtatttcgactcctcaccatcagcagcctgcagcctgaggtattttcgactacttactattgtacaacngtactaactcgtttcctcttcacgtttcggcggtaggaccgaaggtgatanacaaacgactggtagctcgacactacg

SEQ ID NO: 101726 - DNA, 629 bp, Homo sapiens
  misc_feature: GYAE6OF02HEI8N.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccaggggaaacgcccctaagcctcctgatctatggtgcatccagtttaggaaagtggggtacccactaaggttcaggcggcagtgaatcgtagggacagtacttttcacttcctaccaccatcgagcacgtcctgccacgtccgttaggagggttattttcgacctaactttacttattagtacaacgtaggtaccttaaaccgtacgttttacccctcttaccgttaccgttttaccggggaccggggtaaccggggtaaccgtaacggggttaggtaacttaaacgttaacccgaaaaccgggttaaccgttacgggtacgggtaccgttacggaccctaacccgttaacg

SEQ ID NO: 101727 - DNA, 569 bp, Homo sapiens
  misc_feature: GYAE6OF02F2SUF.15.71.G05.1.454.CMB.1.raw
  modified_base (309)..(309): a, c, t, g, unknown or other
  misc_feature (309)..(309): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcagtcagggtattagcagctggttagcctggtatcagcagaaaccagggaaagcccctaagctcctgatctatggtncatccagtttggaaagtggggtcccacgaggttcagcggcagtgaatcgtgggacagtatttcactctacaccatcagcagcctgcagcctgaggtattttgactaactttactattgtacaacgaggtactaactacgtttcccctcttccgtaccgttttcgggaccgggtaacgggaacccgtaagggttacggtaacttaacgtaaccgtaaaacggtaacgttcggttacgggccttacggtacccaccgtaacg

SEQ ID NO: 101728 - DNA, 591 bp, Homo sapiens
  misc_feature: GYAE6OF02HAK4W.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtgcatccagtttggaaagtcggggtacccacgaaggttcagcggcaggtgaatcgtagggacagatttcactctcaccatcagcagcctgcagcctgaggtatttgactaacttactattcgtacaacgtaggtaccttaacgtacgttttccctacttaccgtacgttttccgggccgggtaacggggtacccgtaaaggggttcggtaaacgttaacgttaacccgaaaaccggtaaccgttcgggttacgggtccttacgggaccctaacccgttaacg

SEQ ID NO: 101729 - DNA, 596 bp, Homo sapiens
  misc_feature: GYAE6OF02GPWSP.15.71.G05.1.454.CMB.1.raw
  modified_base (362)..(362): a, c, t, g, unknown or other
  misc_feature (362)..(362): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgcgggcgagtcagggtattagcagctggtagcctggtatcagcagaaaccagggaaacgacccctaagcctcctgactctatggtgcatcctaggtttaggaaaggtcggggtacccaacgaaggttcaggccggnagtgaatcgtagggacagtactttcactctacaccatcagcacgcctgaccagccttgaggttatttcgactaaactttactatttagtaccaacgtaggtaaccttaaccgtcgttttacccttacgtaccgttacgtttaccgggacgggtaacgggtaccgtaaggggttacgtaagttaacgtaccgtaaacggtaacgttcggtacggaccgtagacctacccgttacg

SEQ ID NO: 101730 - DNA, 550 bp, Homo sapiens
  misc_feature: GYAE6OF02JDO6D.15.71.G05.1.454.CMB.1.raw
  modified_base (537)..(537): a, c, t, g, unknown or other
  misc_feature (537)..(537): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaccagggaaacgcccctaagctcctgactctatggtgcatccagtttggaaagtggggtcccacgtaaggttcagcggcaggtgaatcgtagggacaggtatttcactctcaccatcagcagcctgcacgcctgaggtatttcgactaacttacttacgttgtacaacgacggtacctaacgtacgtttaccctctaccttacgtttcgggacggtacggaccgtaagggtgaactaacgtacaaacgtactggtacggtacncggtaccacgtac

SEQ ID NO: 101731 - DNA, 556 bp, Homo sapiens
  misc_feature: GYAE6OF02HX5SP.15.71.G05.1.454.CMB.1.raw
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
tcagtctacgtagccacgaccggtgctcgatttagtgtcgtcgcaagagagagggggtcaggctggaactgaggagcaggtgggggcatttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacnccctaagctctgatctatggtncatccagtttaggaaagtggggtacccacaaggtcagcgnagtgaatcgtgggacagtatttcactctcaccatcagcagcctgcagcctggagttatttgactaaacttacttattgtacaacgtaggaccttaacgtacgtttccctacgttacctacgtttccgggacggtaacgggaccgtaaagggtcggtaactaacgtaaccgaaacgtaacgttggtacggtacgtagacccacgtacg

SEQ ID NO: 101732 - DNA, 586 bp, Homo sapiens
  misc_feature: GYAE6OF02GC506.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccaggtttaggaaagtcggggtacccacgaaggttcaggcggcaggtgaatcgtagggactagtatttcactctcacatcagcagcctgcagtcctagaggttattttagctaaactttacttattcgtacaacgtaggtacttaacgtacgtttccctacttaccgtaacgtttccgggacgggaacgggtaaccgtaaggggttacggaacgttaacgtaaccgtaaaaccgtacgttacgggttacggtaccttacggaccctacctacg

SEQ ID NO: 101733 - DNA, 756 bp, Homo sapiens
  misc_feature: GYAE6OF02I1J4W.15.71.G05.1.454.CMB.1.raw
  modified_base (192)..(192): a, c, t, g, unknown or other
  misc_feature (192)..(192): n is a, c, g, or t
tcagtctacgtagccacgaccggtgctcgatttagtgtcgtcgcaagagagaggggtcgaggctggaactgaggagcaggtgggggcgacttctcctctaacactctccccgctcagctcctgggctcctgctgctctcggttcccaggttccagatgcgacatccagatgagccagtctccatcttccgtntctgacattctgtaggagacagagtccaccatcactttggcgggcattcgagggtattagacgagcgtggttagctggtatcagacagaaaccgtaagggaacgacccgtaacgaccgttacctgaataccgtaagtggttcgactactccgttaaggtttggtaaaagggttccgggttaacccgaaccggttaaggttaccggaaggcgggtaccggtaaggtacggtaaagtaccggttagggaacgtacggtacttttaacgtaccttacttacccgtaacacgtttaccacgtaccgaccgtacgttaccgacgtaacgtccccgttagtacggttaacgtttttcggaacctttaaccgtttaaaccgtttatttacggtttaccaacgtaaccgggtaacctttaacccggttaacctttttacccgttacccgttacttaccgtttaccgggtaccggggtaacggtaacccggtaagggttacggtaacgttaacctaaacgttaaaccggtaacgttcggtttaacgggcctttaacgggaccctacgttaccg

SEQ ID NO: 101734 - DNA, 518 bp, Homo sapiens
  misc_feature: GYAE6OF02F79BV.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccagggaaagcccctaagctcctgatctatggtgcatccaggtttggaaagtcggggtacccacgaaggttcagcggcagtgaatcgtgggacagtatttcactctcacatcagcagcctgcagcctgagtatttgactaacttatattgtacaactaggactaactcgtttaccctctacctacgttcggcgaggaccgtaaggtcgatactacgaacgtacgtgtacggctgacactac

SEQ ID NO: 101735 - DNA, 578 bp, Homo sapiens
  misc_feature: GYAE6OF02IT49Q.15.71.G05.1.454.CMB.1.raw
  modified_base (358)..(358): a, c, t, g, unknown or other
  misc_feature (358)..(358): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatgtgcatccagtttggaaagtgggtcccacaaggttcagcgcagtgaatcgngggacaggtactttacgactctccaccatcagcagcctgcacgccgtagaggtattttacgactaacttacttacgttgtactaacgacggtacctaacgtacgttttccctcttaccgtacgttttaccgggacggtacgggtaaccggtaagggttacggtaacgttaacgtaccgtaaacgtaacgttacggttcggacgtcggaccgaccgttacg

SEQ ID NO: 101736 - DNA, 537 bp, Homo sapiens
  misc_feature: GYAE6OF02IXFRU.15.71.G05.1.454.CMB.1.raw
  modified_base (451)..(451): a, c, t, g, unknown or other
  misc_feature (451)..(451): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtacccaccgaaggttcagcggcagtgaatcgtgggacaggtatttcactctcaccatcagcagcctgcagcctgagtatttgactaacttatattgtacaacgagctaactagtttcccncttacacgtttcggcggaacgggtaccgtaaagggtcgtagttaactacgaaaaccggtaactggtacggcgttacgacacctacg

SEQ ID NO: 101737 - DNA, 566 bp, Homo sapiens
  misc_feature: GYAE6OF02GI2XW.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtcggggtcccaccgaaggttcagcggcagtgaatcgtgggacagtatttcactctcaccatcagcagcctgcagcctggagtattttgactaacttacttattcgtacaacgagtaccttaactacgttttcccctcttacctacgttttccgggacgggtacgggtaacccgtaagggtacggtaattaacgtacgaaaaccgtaacgttcgggtacggtacgtcggtaccaccgtacg

SEQ ID NO: 101738 - DNA, 545 bp, Homo sapiens
  misc_feature: GYAE6OF02H646U.15.71.G05.1.454.CMB.1.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctggtaggagacagagtcaccatcacttgtcgggcgagtcagggtattagcagctggttagcctggtatcagcagaaaccagggaaacgcccctaagctcctgatctatggtncatccagtttggaaagtcggggtacccacgaaggttcagcggcagtnaatcgtgggacagtactttcactctcaccatcagcagcctgcagccttggagtattttcgactaacttactatttacgtaccaacgacgtacttaactacgttttccctacttcctacgtttccggacgggtaacgggaccgtaaggtacggtaatagtaaccaagactcggtgctagaccactac

SEQ ID NO: 101739 - DNA, 568 bp, Homo sapiens
  misc_feature: GYAE6OF02IT1K9.15.71.G05.1.454.CMB.1.raw
  modified_base (447)..(447): a, c, t, g, unknown or other
  misc_feature (447)..(447): n is a, c, g, or t
tcagtctacgtagccacgaccggtgctcgatttagtgtcgtcgcaagagagagggggtcaggctggaactgaggagcaggtggggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcgagggtattagcagctggttagcctggtatcagcagaaccagggaagccctaagctctgatctatggtgcatccagtttaggaagtcggggtcccacgaggttcagcggcaggtgaatcgagggacagtattttccactctacacctatacagcacgcctgccagtcctggtaggtattttgacctaactttactattgtactaacgnggtacttaactccgtttcctactccgtacgtttacgggccgggtaacgggtaaccgtaagggtacggtagtaacgtaaccgaaacggtaacgttaggtcggtacctacggtacgacctacg

SEQ ID NO: 101740 - DNA, 597 bp, Homo sapiens
  misc_feature: GYAE6OF02IDNCZ.15.71.G05.1.454.CMB.1.raw
  modified_base (285)..(285): a, c, t, g, unknown or other
  misc_feature (285)..(285): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcacatcacttgcgggcagtcagggtattagcagcgtggttagcctggtatcagcaagaaaccagggaacncccctaagctcctgatctatggtgcatccagttaggaaagtcgggtacccacgaagtcagcgnagtagatctgggacagtatttcacttcnccgaactanactagctagcctagcagcctagagtatttcgactaactttactagttgttaccaaacgtacggtaccttaaaccgtacgttttcccctacttaccgttaccggttttccgggaccgggtaacgggtaacccgtaaggggttacggtaattaacgtaacccgtaaaaccggtacgttacgggtccggtaccgttacgcccgtaacccttaacg

SEQ ID NO: 101741 - DNA, 549 bp, Homo sapiens
  misc_feature: GYAE6OF02HYL0M.15.71.G05.1.454.CMB.1.raw
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
tcagtctacgtagccacgaccggtgctcgattttagtgtcgtcgcaagagagagggggtcaggctggaactgaggagcaggtggggggcacttctccctctaacactctccccgctcagctcctggggctcctgctgctctggttcccaggttccagatgcgacatccagatgagccagtctccatcttccgtgtctgcatctggtaggagacagagtcaccatcacttgtcgggcgagtcagggtattagcagctggttagcctggtatcagcaagaaaccagggaaacncccctaagctcctgatctatggtncatccgtagttaggaaagtcggggtacccacgaaggttcagcgctagtgaatcgtagggactagtatttcactctcactatcagcagctgcagcctgagtntttgactaacttactagttcgtacaacgtagtacttaacgtaccgtttccctactacgtacgtttcgggacggtacgggtaccgtaaggttacggataacgtacgaaacgtactggtacgactgaccactacg

SEQ ID NO: 101742 - DNA, 536 bp, Homo sapiens
  misc_feature: GYAE6OF02GCXI8.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcagtcagggtattagcagctggttagcctggtatcagcagaaaccagggaaagcccctaagctcctgatctatggtgcatccagttggaaagtggggtcccaccaaggttcagcggcagtgaatcgtagggacagatttcactctacaccatcagcagcctgcagcctgagtattttgactaacttactattagtacaacgaggacttaacgtacgtttccctcttcctacgtttcgggacggacgggtacgtaagggtcgaagttactacgaaacgtacgtacgtaggtactcgtccactacg

SEQ ID NO: 101743 - DNA, 570 bp, Homo sapiens
  misc_feature: GYAE6OF02FZ02I.15.71.G05.1.454.CMB.1.raw
  modified_base (366)..(366): a, c, t, g, unknown or other
  misc_feature (366)..(366): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcagggtattagcagctggttagcctggtatcagcagaaaccgagggaaacgcccctaagctcctgatctagtggtgcatccgtaggtttaggaaacggtcggggtacccaacgtaaggttcaggcggnagtgaatcgtgggacagtactttcactctcacatcagcacgcctgcagcctggtaggttacttttgaccttaactttacgttattacgtaccaacgtacggtaactaacgttacgtttccctacttacgtacgtttccgggacggtacggaccgtaagggtcgtaactaactacgaacgtacgtggtacgctacgaccactacg

SEQ ID NO: 101744 - DNA, 612 bp, Homo sapiens
  misc_feature: GYAE6OF02GC9Q2.15.71.G05.1.454.CMB.1.raw
  modified_base (208)..(208): a, c, t, g, unknown or other
  misc_feature (208)..(208): n is a, c, g, or t
  modified_base (321)..(321): a, c, t, g, unknown or other
  misc_feature (321)..(321): n is a, c, g, or t
  modified_base (458)..(458): a, c, t, g, unknown or other
  misc_feature (458)..(458): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagagtcaccatcacttgcgggcgagtcagggtattagcagctggttagccgttggtatcagcaagaaaccgagggaaacgccccgtaaagcctcctgacttctagtgggtncacttccgtaggtttaggaaacggttcggggtacccaaccgtaagggtttccaaggccgggtacaaggtgaaactcgtacggggaactaggtacttttaccactcctacacccgattccaagcacgtcctgaccganccgttaggagttattttcgaccttaactttattacttcggaactaacgacggtacttaacgtacgtttccctacttctaccgttacgggcgaccgggtacgtaagggtcgaagttacgaacgtaaacggtacgtggtaggcctgacctactacg

SEQ ID NO: 101745 - DNA, 627 bp, Homo sapiens
  misc_feature: GYAE6OF02JBHZY.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccagggaaacgcccctaagctcctgatctatggtgcatccagtttggaaagtcggggtacccaccgaaggttcaggcggacaggtgaatcgtagggactagtacttttcgactcctaccaacctatccaagccaacgcctgaccagccttaggacggttattttcgaacctaactttactagttacgttacaaacgtaggtaccttaaccgttacgttttaccctcttaccgtaccgttttaccgggaccgggtaacggggtaaccgtaagggttacggtaacgttaaccgtaaccgtaaaacggtaaccgttacgggttacgggtaccgtacggtaccctaccgtaacg

SEQ ID NO: 101746 - DNA, 585 bp, Homo sapiens
  misc_feature: GYAE6OF02GMKZM.15.71.G05.1.454.CMB.1.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcagtcagggtattagcagctggtagcctggtatcagcaagaaaccagggaancccctaagctcctgatctatggngcatcctagtttggaagtggggtacccacgaaggttcagcggacagtgaatcgtgggacagtatttcactctacacctatcgagcagcctgccaggtcctgaggttactttgacctaactttactattacgaccaacgtacggtacttaaacgttccgttttacccctacttaccgtacgtttccgggacgggtaacgggtacccgtaaagggtacggtaacttaaccgtaaccgtaaacggtacgttgggtacggtacctcggtaccctacgtaacg

SEQ ID NO: 101747 - DNA, 684 bp, Homo sapiens
  misc_feature: GYAE6OF02IBL3O.15.71.G05.1.454.CMB.1.raw
  modified_base (329)..(329): a, c, t, g, unknown or other
  misc_feature (329)..(329): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtccaccatcacttggtcgggcgagtcagggttattagcagcgttggttagcctggtatcgagacaagaaaaccgaggggaaaccgcccctaaagcctcctagacttctagtggtncacttccgtaggtttaggaaacggttcggggtaaccccaaccggtaaagggtttaacggccggtactaaggtagaaacgttcggtagggaactaggtatttccaacgttctaccacctagtccaggacctcgcctggaccacgtccgtaggtaagttacttttcgaccttaaacttactagtttacgtaccaaacgtacggacctttaaacgttccgttttacccctacgttaccttaaccggttttccggggacggtaacggggtaaccgtaaagggttacggtaacttaacggtaaccgtaaaacggtaacggttcggtacggtaccgttacggacccttaccgtactttccg

SEQ ID NO: 101748 - DNA, 1063 bp, Homo sapiens
  misc_feature: GYAE6OF02GOUS6.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcgatacttgtaggagacagagtacaccactctacgttcgtcgggcggtacgtcgtacgggtaagttacgacgacgtacgttggttacggtaccttcgggtaagttccagacgaacggaaaacccgaacggggaaacggtaccccctaaaccggtacgtaccccgtagtagtacttacgtggttacggtcctaacgttacccgttaagggttttaaggggtaaaacgggtttaccgggggggttacccccttaaaacccggtaaaccggggtttttaaccggaaccggggtaccggggtaccgtaaacggggtttacgggtaaaaccggttaccggttaaccggggggaacgtaaacggggtttaacccttttttaacccttaacccgggtttaccctaccccgtttaaaaccccgtaaacgtttaacccggaaaacgggtaccccaaaacgggttcccccgtttacgggaaccccggtttaaaccgaccccgggttagggtttaaacggggtttaacgttttttaacccgtaacccgttaaaaacgtttttttaacccgtaacgtttttagggtttaaaccccaaaacgggtaaaccgggttacccgtttaaaacgttttacccgttttccccccgttttaccgtttaaccgggtaaccccgggttttttaacgggacccggggggggaaaacccggggttttaaaccccggaaacggggggggtttttaaaacggttaaaccccggtttaaaacgttttaaacccccggggtaaaaaaaccggtttaacccggttttccggggggtttaacccggggtaaccggtaacccccgggtttacctaaaccccccccggggtttttaagg

SEQ ID NO: 101749 - DNA, 597 bp, Homo sapiens
  misc_feature: GYAE6OF02GLV57.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagggagacagagtccaccatcactttggcgggcgagtcagggtattagcagctggttagcctggtatcagcagaaaccagggaaacgcccctaagcctcctgactctagtggtgcatcctagtttacggaaaggttcggggtacccaacgtaaggtttcacggcggacagtagactgagggacagtactttctacttacctcacctatacgacgacgacgcctgccgacgtcgtcggtagtattttacgactaaacctttacttattcgtactaacgtacgtacgttaacttacgtttccctacttcgttacgtttcgggacgggtacgggaccgtaaggtacggtactaacgtaacgtaacgtacgttggtacggtctacggacaccgttacg

SEQ ID NO: 101750 - DNA, 594 bp, Homo sapiens
  misc_feature: GYAE6OF02GO4OE.15.71.G05.1.454.CMB.1.raw
  modified_base (304)..(304): a, c, t, g, unknown or other
  misc_feature (304)..(304): n is a, c, g, or t
  modified_base (487)..(487): a, c, t, g, unknown or other
  misc_feature (487)..(487): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcaagaaaccgagggaaacgcccctaagcctccgngatctagtggtgcatccgagtttaggaaagtcgggtaccacgaagttcagcgcgagtgatcgtggacagtatttcactctacacctatcagcagccgtagccacggtcctaggtaggttattttcggacttaactttacgttattcggtaacacgtaggacctttaacgtccgtttacccctnttacccgttactttccgggacgggtacggggtacctaaggggttcgaacgttaacgtaaccgtaaaggttacgttcgggtacggaccgttacggcctaaccgtaccg

SEQ ID NO: 101751 - DNA, 635 bp, Homo sapiens
  misc_feature: GYAE6OF02HFPMY.15.71.G05.1.454.CMB.1.raw
  modified_base (364)..(364): a, c, t, g, unknown or other
  misc_feature (364)..(364): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcgagtcgagggtattagcagcgtggttagcctggtatcagacaagaaaaccgagggaaacgcccctaagcctcctgatctagtggtgcatcctaggtttaggaagtcgggaccaacgtaggttcagcgganagtagaatcgtaggactagtactttcgactctacacatcagcacgccgtgacgacgtccgtaggtaggttacttttcgaacttaactttacttagtttacgtaaccgtaaacgtacggtaccttaaccgttacgttttacccctacttaccgttaccgttttaccggggacgggtaacgggtaacccggtaaagggttacggtaaacttaacggttaaccgaaaacgggttaccgttgggtaccggtaccgtacggtacctaaccgttacg

SEQ ID NO: 101752 - DNA, 582 bp, Homo sapiens
  misc_feature: GYAE6OF02HRYER.15.71.G05.1.454.CMB.1.raw
  modified_base (314)..(314): a, c, t, g, unknown or other
  misc_feature (314)..(314): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagtcagtctccatcttccgtgtctgcatctgtaggagacagagtcaccatcacttggtcgggcgagtcagggtattagcagctggtagcctggtatcagcaagaaaccagggaaacgcccctaagcctcctgatctagtggtncatccgtaggtttacggaaacggtcgggtacccacgtaaggttcaggcggacaggtagaactcgtagggacagtactttcactctaccaccatcacgcacgccgtgcgacgtccgtgtagttactttcgacttaacttacttattcgtactaacgacgtaccttaacgtaccgtttccctctaccgtacgtttccgggacgggtacggtacgtaagggtacgtagtaactacgaaacgtacgtgtacggtctacggacctaccgtacg

SEQ ID NO: 101753 - DNA, 540 bp, Homo sapiens
  misc_feature: GYAE6OF02HPEVZ.15.71.G05.1.454.CMB.1.raw
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacncccctaagcctcctgactctagtggtncatccgtaggtttggaaacggtcggggtacccacgaaggttcagcggacagtgaatcgtagggacagtatttcactctaccacatcagcacgcctgcacgccgtagtagtattttcgactaacttactattcgtacaacgagtctaactcgtttcctctactacgttcggacggaggtaccgtaaggtgtatatacgaaacgtacgtgtacgcgtacgaccactac

SEQ ID NO: 101754 - DNA, 700 bp, Homo sapiens
  misc_feature: GYAE6OF02H5PR0.15.71.G05.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctaccatctttccgtgtctgcatctgtagganacagngtcacatcacttgtcgggcagtcagggttattagcagcgtggttagcctggtatcgagcaagaaaaccaggaaaccnccctaagctaccngtatctagtgtcgcactcgtagtttaggaaacgtcggggtaccctaacgtaaggttcgaagtcggacagtagaactcgtagggactagtacttttcgactacttcacctacgtacgacgacgacgtccgtggctaacgtccgtaggtacggttacgttttacgtaacttaaaccgtttacgttaacgtttacggtaactaaaccggtaacggtaccgttaaaccgttaaccgttttaccccgttacttaacccgttacccggtttttacggggaccgggttaaccggggtaacccggtaaacgggttacggttaaacgttaaacggttaaacgtaaaacccggtaacgtttacggtaaccgggttaccggtacggtaccctaacccgttaaccgg

SEQ ID NO: 101755 - DNA, 651 bp, Homo sapiens
  misc_feature: GYAE6OF02IREPO.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctgggctcctgctgctctggttcccaggttccagatgcgacatccagatgagccagtctccatcttccgtgtctgcatctgtaggagacagagtcaccatcacgttgtcgggcgagtcgagggtattagcagcgtaggttacgccgtggtactcagcaacggaaaccgaaggggaaacgacccccgtaagcctaccgtagactcgtagtggtgctagtctaggttaggtaacggtcgggtacccacgtaagttcgaacggcggacacgtagtaagtcgtagggactaggtactttacgacttcctactaaccgatacgacgtacctaggccctagccgtagtccgttagtacggttacttttcgtaaccttaaacctttacttagttacgtactaaacgacggtaaccttaacgttaccttttcccgtacttcctaccgtttcgggaccgggtaacggtaaccgtaagggtaggtaactaacgtaacgtaaacccgtacggttcgggtacggtactacggtcccacgtacg

SEQ ID NO: 101756 - DNA, 780 bp, Homo sapiens
  misc_feature: GYAE6OF02JNSM9.15.71.G05.1.454.CMB.1.raw
  modified_base (202)..(202): a, c, t, g, unknown or other
  misc_feature (202)..(202): n is a, c, g, or t
tcagtctacgtagccacgaccggtgctcgatttagtgtcgtcgcaagagagaggggtcgaggctggaacgtgaggagcaggtgggggcgacgttctccctctaacactctccccgctcagctcctgggctcctgctgctctggttcccaggttccagatgcgacatccagatgagccagtctccatcttccgtgtctgcatntgtaggagacagagtcaccagtcactttggtccgggcgagttcgagggttattagcgagtcgtggttacgcctggtatcgagcagaaaccaagggaacgaccccgtaagacctcctagacttactagtcggtgactactccgtaaggtttagggaaacggttcgggggaccccaacggttaaagggtttccaaacgggtccgggtacgaacggttacgaaacgttacgttacggggggaactaacgggtttaaccttttctaacccgttaccgtacctaacccgtaacgttacccgaaacgttaccgaaccggtcctttacggcccgtacggttacccgttacgggtaacgggttaacgttttaccggttaaccttaaacgtttaaccgttttaacgttaacggtttaccgtaaaccgttaacgggtaacccgttaaaccgtttacccgtttaccccgtttacccttaccgttaccgttttaccgggaccgggtaacgggtaaccggtaacggggtacgtaacgtaaccgttaaccgaaacgtacgttacgggtagtaccgtacggtaccaccgtacg

SEQ ID NO: 101757 - DNA, 664 bp, Homo sapiens
  misc_feature: GYAE6OF02GDXFO.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatcgtgtaggagacagagtcaccatctacgttggtcgggcgtagtcgagggttatagcaggtctggttacgccgttggtactcgagacgaacggaaaccgaggggaaaccgtcccctaaggcctaccgtagactccgttaggtgggcgactaacgtccgttaggtttagggaaacggttcggggtacccaacggtaaggttccgaacggcggactaggtagaacgttcggtaggggaactagttactttaccaccttaccgtacaacctacgtaccaggaccacggtccgtgaccacgtccgttaggtacgttactttcgaaccttaacttacttagttctaacgaacgacgttactaaccgttacgtttccctacttacgttaccggttcgggaccggtacggtaccgtaagggtacgtaataccgtaacgaacggtgttacggtcgtcgtacgtaccctagtacg

SEQ ID NO: 101758 - DNA, 724 bp, Homo sapiens
  misc_feature: GYAE6OF02HHO5E.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcggcgagtcagggtattagcagctggttagcctggtatcgagacgtaagaaaacccgaagggaaaacgtacccccgtaagtcccgttccgtacgtacttccttaagtgggtacgtacctaacgttacccgtaaggttttagggaaaacggttcgggggtacccctaaccggtaaacggtttccgaaggaccgggacgtaacggttaggaaacgttcgtacggggaactaggtacttttcgaacgttcctaccaacccgtactacgaacggtaccaacgtccgtgtccgacgtccgtaggttaacggtacttttgaacttaacctttaacttagttaccgtaacgtaaccgtacggaccttaaaccgtaccgtttacccgtccttaccgttaaccgtttccgggaccggtaacgggtaacccgtaaggggttagtaacgtaacgttaacccgaaaaccgttaaccgtggtacggtaccgtacgtaccgaacctacgg

SEQ ID NO: 101759 - DNA, 575 bp, Homo sapiens
  misc_feature: GYAE6OF02IDHF4.15.71.G05.1.454.CMB.1.raw
  modified_base (311)..(311): a, c, t, g, unknown or other
  misc_feature (311)..(311): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaacgcccctaagctcctgatctatggtncatcctagtttaggaagtgggtacccacgtaaggttcagcggcagtgaatcgtagggacagtctttcactctacacatcagctacgccgtgccagtcctagaggttattttgacctaactttacgtattcgtacctaacgaggtaccttaacgtaccgttttaccctcttaccgtacgtttacgggacgggtaacgggtaaccgaagggttacgtaactacgtaccgaaaacggacgttggtacggacgtacggtaccactacg

SEQ ID NO: 101760 - DNA, 567 bp, Homo sapiens
  misc_feature: GYAE6OF02FI5J7.15.71.G05.1.454.CMB.1.raw
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcaggggtattagcagctggttagcctggtatcagcaagaaaccaggggaaacncccctaagcctcctgatctatggtncatccgagtttggaaaggtcgggtcccacgaggttcagcgnagtgaatcgtgggacagtactttcactctacaccatcagcacgtcctgacacgtccgtgaggttattttgactaactttacttattcggtactaacgtaggaccttaaccgtacgtttccctcttactaccgtttcgggacggtaacgggaccgtaagggtgtaactacgtaacgtaaacggacgttggtacggtctacgtacgtacctag

SEQ ID NO: 101761 - DNA, 592 bp, Homo sapiens
  misc_feature: GYAE6OF02H3QFB.15.71.G05.1.454.CMB.1.raw
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtcgggcagtcagggttattagcagctggttagcctggtatcagcaagaaaccagggaaacgcccctaagcctcctgatctatggtncatcctagttaggaaagtcggggtacccacgtagttcagcgganagtgagtcgtagggacagtactttcactctcacatcagcagcctgcgtacgccgtagtaggttacttttcgaccttaactttacttagtttacgtaccaacgtacggtaccttaacgttaccgttttccctcgttaccttacggtttccggacgggaacgggtaaccgaagggttggtaattaacgtacccgaaacggtacgttcggtacggtcgttacggaccgtacgttacg

SEQ ID NO: 101762 - DNA, 617 bp, Homo sapiens
  misc_feature: GYAE6OF02IZD35.15.71.G05.1.454.CMB.1.raw
  modified_base (404)..(404): a, c, t, g, unknown or other
  misc_feature (404)..(404): n is a, c, g, or t
  modified_base (505)..(505): a, c, t, g, unknown or other
  misc_feature (505)..(505): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttccccaggttccagatgcgacatccagatgagccagtctccatcttccgtgtctgcatctggtaggagacagagtccaccatcacttggtccgggcgagtcgagggtattagcagctggttagcctggtatcgagcaagaaaccgaagggaacgcccctaagctacctgactactagtggtcgactactccgtaagtttaggaacggtcgggtacccacgtaagttcgacgtcgactagtagaatcgaggacagtactttcnctactacactatacgagcagccgtagcgtagcctaggagttcttacgacttaaccgttatattacgtactaacgtacgtaactaacgttccgttttacccncgttaccgttaccgtttacgggacgggtaacgaccggtaagggtaccggtaaattacgtaacgtaaacggtacgttcgggtaccggtacgtacggtacccgtaccgttaacg

SEQ ID NO: 101763 - DNA, 646 bp, Homo sapiens
  misc_feature: GYAE6OF02GSGUW.15.71.G05.1.454.CMB.1.raw
  modified_base (312)..(312): a, c, t, g, unknown or other
  misc_feature (312)..(312): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggtagcctggtatcagcagaaaccgagggaacgcccctaagcctcctgatctagtggtnacatccgtaggtttaggaaaggtcggggtacccaacgtaaggttcgacggcgacgaggtgaacgtcgtagggacaggtacttcgtactcctaccgacctacacacgcacgccgtagccagtccgtaggtacgttactttacgacttaaaccgtttacttaagttcggtaaccaaacggttacgtaaccgtttaaccgttaccgttttccctacgttaccgttaccgtttaccggggaccgggtaacgggtaacccggtaaggggttacggtaacttaacggtaaccgtaaacggtaccggttaggtcggtacctacggtacccaccgttaaccg

SEQ ID NO: 101764 - DNA, 601 bp, Homo sapiens
  misc_feature: GYAE6OF02FXF0V.15.71.G05.1.454.CMB.1.raw
  modified_base (314)..(315): a, c, t, g, unknown or other
  misc_feature (314)..(315): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctaggtatcgagacaagaaaccgagggaacgccctaagcctctgatctaatggnnactccgtagttaggaaggtcgggacccaacgtaggtcagcggcaggtnaagtcgtaggacagtatttcnctcacacatcagcacgtcctgacagcgtagagtatttgaacgttaactttactatttacgactaacgtacggtaaccttaaccgttacgtttaccccttcgttaccgttaaccgtttcgggtaacccgggtagggtaacccgtaacgggttacggaacgtttaaccgaaccgtaaaccgggtaacttgggtacggtccggtagtaccccattaaccg

SEQ ID NO: 101765 - DNA, 964 bp, Homo sapiens
  misc_feature: GYAE6OF02F3680.15.71.G05.1.454.CMB.1.raw
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtntctgctatctagtagganacagngtccaccagtcacttggtcgggctagtcagggttattagcagtcgtggttacgccgtggtactcgagtacgaacgtaaaccgaacggggaaactccccgtaaacggtctaccgtacggtaacctacgtttaacgtcgggttacgccgttaaacgttcccggttaagggttttacggggaaaacggggttcccgggggttaccccgtaaacccggtaagggggttttacccgaacggggtacccgggtacccgttaaagggtaccggttaaaacgttccgggttaacgggggtaaacccggttaggttaacccggttttacctaaaccccggtttcccgttaacccgtaaaccccgtttagtaacccgggtaaccgtacccggtaaccgggtaccccggttacggtacccgtaaccgggtttaacccgttaacgggttaacgggtttaacccgtttttaccgaacccgtttaaaaccgttttaaccggtttaatttaaccggtaaacccggttaaacccgtaaccggttaacccggttttaaaccgttacccggtttttaaccccgtttaccgttaaccccggtttaaccgggttttacccggggtacggggttaaaccccgggttaacccgggttaaacggggttaacggggttaaacccgtaaccggttaaacccggttaaaaccggttaaccggtttagggttacccggtaaccggtttacccgtaaccgttacccggttaaacccg

SEQ ID NO: 101766 - DNA, 548 bp, Homo sapiens
  misc_feature: GYAE6OF02G3AEH.15.71.G05.1.454.CMB.1.raw
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (536)..(536): a, c, t, g, unknown or other
  misc_feature (536)..(536): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtccaccatcctacttggtcgggcgagtcgagggtattagcagctggttagcctggtatcagcaagaaaccgaggggaaacnccccgtaagcctccagatcgtagtggtncatccgtaggtttaggaaaggtcgggtacccacgtaaggttcaggcgganaggtgaagtcgtaggacagtatttcactctacactatcagcacgctgacncgccttgagttnttcgactaacttntattnactaagcggtactaacgttctttccctactcttacgttcgggacggaggaccgaggtacgataactacgtaacgagtggtcgntcgaccactacg

SEQ ID NO: 101767 - DNA, 602 bp, Homo sapiens
  misc_feature: GYAE6OF02GM14P.15.71.G05.1.454.CMB.1.raw
  modified_base (367)..(367): a, c, t, g, unknown or other
  misc_feature (367)..(367): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagtctggttagcctggtatcagcagaaaccagggaaacgcccctaagctccgtgatctagtggtcgcatcctaggtttacggaaagttcggggtacccaaccgtaaggttcaggcggnagtgatctgggacagtactttcactctacacatcgacgcacgcctgcacgcctaggtacgtattttcgaccttaactttacttattcgtacaacgacggtactaacgttacgttttccccttacgttaccgtaccgttttccgggaccgggtacgggtaacccgtaagggttacggaagttaaccgtaaccgtaaaacggtacgttcggtacgggtcctaggaccgtaccttacg

SEQ ID NO: 101768 - DNA, 746 bp, Homo sapiens
  misc_feature: GYAE6OF02H1779.15.71.G05.1.454.CMB.1.raw
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggtcccaggttccagatgcgacatccagatgagccagtctccatcttccgtgtctgcatcgtgtaggganacagagtcaccagtccacgttggtcgggcgagtccgaaggggttattagcagcctaggttagccgtggtatcgancgagaaaccgagggaaacnccctaagctacctgattcgtagtggtgcagttcctaggtttaggaaaggtcgggggtacccacgtaaggttacacggcggaccgaggtacgtaatccggtaggggtaaccaaggtacttttaccgaacggttacttacccaacccgtaagttacccgtaggtacccgagttaaccccgtgtacccgacgttacccggttaggtaacggtttagttttacggaaccgttaaaccgtttaaacttcgttacgttaaccgtaaaccgtacgggtaaccttaaacgttacccgggttttccctaacggttacctttaaccgggttttcccgggaacgggttaaccggggtaacccgtaaacgggttaggtaacctaacggttaaacccggtaaaccgtaacgttcccggttaggggtacccctttacggacccgtaacgttaacccg

SEQ ID NO: 101769 - DNA, 756 bp, Homo sapiens
  misc_feature: GYAE6OF02IHR2R.15.71.G05.1.454.CMB.1.raw
  modified_base (353)..(353): a, c, t, g, unknown or other
  misc_feature (353)..(353): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctcgtggttcccaggttccagatgacgacatccagatgagccagtctccattcttccgtgtctgctatctagtaggagacagatccaccactctacgttggcgggcgtagtcgagggttattagcagtcgtaggtttacgctaggtactacacggacacgaaaaccgaaagggaaaccgtaccccgtaaggtcctaccttaggattcgtagtagggtncctagttaccgtaaggttttaggaaacgggtcggggtacccctaaaccgtaaggttcgaacggtccgggactaacggtagtaacttacgtagggaacctagttaactttcgaaccgttctacccgtaaccaagttccaacggtaccaggtaccctggacccgtaacgccgttaggtaacgggtttacttttacgaacccgttaactttaaccgttacttacggttaccgaacttaccgggtaaccttaaccggttaccgttttccccctacgtttaccgtacccggtttacgggaccggggttaaacggtaacccggtaaaggttccggaaacgttaaccgtaaaccggaaaaccgttacgttaccggggttccgtaacggtaccgtaccgtaccttaaccgg

SEQ ID NO: 101770 - DNA, 832 bp, Homo sapiens
  misc_feature: GYAE6OF02GUSRB.15.71.G05.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcagggtgggggcacttctccctctaacactctcccgctcagctcctggggctcctgctgctctggttcccaggttccagatgcgacatccagatgagccagtctcatcttccgtgtctgnactctgtagganacagtagtccacatccacgttggtccggggcgtaacgtgtaaggggttatttaacgctaacggtcgttaggggtttacgtccccgttaggggtttactcgaacggtaccaaacggaaaaccccggtaaacggggaaaacccggtaaccccccgttaaacgggacccttcccgttaaggaaccgtttaccgttacgtagggggttccgtacctaaccgtttacccgttaaaggggttttaggggtaaaacgggtttaccggggggtacccctaaaccggttaaaccggggtttacgtaaccgggaccgggtaccgtaaggggtagtaaaccggtttacgaacggggggtaaacttaacggttaaacttttcccggtaaccgtttcctttaaccgaacccgtaacgtttaccgaaccgtacgtaccggaccctcggaccgtacggaccgttacggtaggtttacgtttagacgtttaacttacgttattacctacgaaccgtaacggtactaaaccgttccgtttaccccttacgttacctacggtttaccgggacggtaaccggaccggtaaggtaccggtaatacgaaccgtaacgacgttaggacgtactacgacctactacg

SEQ ID NO: 101771 - DNA, 840 bp, Homo sapiens
  misc_feature: GYAE6OF02HSYIW.15.71.G05.1.454.CMB.1.raw
  modified_base (212)..(212): a, c, t, g, unknown or other
  misc_feature (212)..(212): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctggttcccaggttccagatgcgacatccagatgacgccagtcctccatcttccgtgtctgctatcgtggtagganacagacgtccaccatcacttggtcggcgtagtacgtaagggttattaggcgtagtcgttagggttacgccgttgggtaacttcgaacggtaccaaaggtaaaaacccggaacggggtaaaaccctaccccccgttaaaaggtcccgtttaacccgtaggtaaaccttttaccgtaaacggttaggggttccgaacccgttacgtttaacccggttaaaggggtttttaaccggggaaaaacgggtttcccgggggtaacccccaaaccggttaaaaggggtttcccaacggggacccggtcgtaaacggttaacggtaccgttacggtaacgggggaacttaacggtaccgttttaaccacccgttacgtacctaaccgtacgttacacggtacgtaccgtccgtcgtacgtaccgtaccgttagggtaacgttacgtttccgaacttaactttaacgttacgttcgtaaccgtaaggaacgttaaccttaaccgttacgtttacccctagtaacccgtttccgttaccgggaccgggtaaccggtaccggtaaacggtaccgtaagtaaaccggttaaccgaaacggtaccgtaggttaccgaccggttacaccgtaaccgttaccg

SEQ ID NO: 101772 - DNA, 625 bp, Homo sapiens
  misc_feature: GYAE6OF02IBAEB.15.71.G05.1.454.CMB.1.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (422)..(422): a, c, t, g, unknown or other
  misc_feature (422)..(422): n is a, c, g, or t
tcagtctacgtagccacgaccggtgctcgatttagtgtcgtcgcaagagagagggggtcaggctggaactgaggagcaggtgggggcacttctccctctaacactctcccccgctcagctcctggggctcctgctgctctggttcccaggttccagatgcgacatccagatgagccagtctccatccttccgtgtctgcatcgtgtaggagacagagtccaccatcacttggtccgggcgagtcgagggtattagcagctggttancctggtactcagcagaaaccgagggaaacncccctaagctcctgactctagtggtgcatccgtagtttaggaaagtcggggtacccaccgtaaggttcaggcggcagtgaatcgtagggactagtacttttcactcctaccaaccatacagcgacnccgtgcagtcctaggagttactttgaacttaacttactattcgtacacgtaggtaccttaacgtacgttttaccctcgttaccttacggtttaccggaccggggtaacgggtaaccggtaagggttacggtaacttaacgtaaccgtaaaaccggtaacggttacgggttacgggtaccttacggtaccctaaccgttaaccg

SEQ ID NO: 101773 - DNA, 839 bp, Homo sapiens
  misc_feature: GYAE6OF02ISD2M.15.71.G05.1.454.CMB.1.raw
tcagtctacgtagccacgaccggtgctcgatttagtgtcgtcgcaagagagagggggtcaggctggaactgaggagcaggtgggggcacttctccctctaacactcctccccgctcagctccgtgggctcctgctgctcgtcggttcccaggttccagatgcgacatccgagatgacgccagtcctaccattcttccgtgtctgctacttctaggtaggacgacgaggtactccaacctatccgtacgtttcgggtcgggcgtaggtacgtaaggggttaattacggacgtacggtcgttgggttaacgtccgttaggttactcgaacgaccgaacggaaaaccggaaggggaaacccgtacccctaaggtccttaccgtaggtacttacgtagtgggtcacctagttaccggtaggtttacgggaacgggttccgggtaacccctaacggtaacggttacgacggtacggtacgtaaggtaaggtaacgttacgggtaggtaaccgtagtttacctttacctaccgttaccttacccaacctagtaccgacgacgtaccggtccttacggaccctacgggttccgttaaggttaaggttttaccgttttaacgtaacccgtttaaacgtttaacgttaagttccgtaaacgtaaacggtttaccgtaaaccgtttaacccgtttacccgtttttcccgtaaccgtttacccggttaacgggtttacccggggacgggtaaaccgggtaacgtaacggggttaaccgtaacttaacccggttaacgtaaaccgggttacttcgggtaccgtacgttaacccgaccgttaaccttaccgg

SEQ ID NO: 101774 - DNA, 756 bp, Homo sapiens
  misc_feature: GYAE6OF02IZFY3.15.71.G05.1.454.CMB.1.raw
tcagtctacgtagccacgaccggtgctcgatttagtgtcgtcgcaagagagagggggtcaggctggaactgaggagcaggtgggggcacttctccctactaacactctccccgctcagctccgtgggctcctgctgctctggttcccaggttccagatgcgacatccagatgacgcagtctcatctccgtgtctgcatctggtaggagacaggactacacctatctacgttggcggacgtagtcgaagggttatagacgagtcgtagggttacgccgttaggtactcgaacgtacgaaacggaaaaccggaagggaaacccgtaccccgttaagtcccgtaccgtagtaccgttacgttaggtcggtacgtacctacgttaccgtaagggtttaacgggaacggttcccgggtacccaaggttaacggttcgacgggacgtacgtaaggtcgtaacgtcggtacgggaacttacggttacttttaccgactaccgtaccactaacgttcgacgtacgtaccgtcgtacgacgtcgtaccggttagtaacggtttactttaccgtaaacttaacgttttaacgttacgttaccgttaacgaaaccggtacgttaaccttaacgtttaaccgtttcccgttaactttaccggtaccggtttaccgggacggttaacgggtaccgtaagggttaacgttacgtaaccgaacccgtaaggttacgtagggtaccgtacgaccggtaccgtagttaacccg

SEQ ID NO: 101775 - DNA, 732 bp, Homo sapiens
  misc_feature: GYAE6OF02IFS4B.15.71.G05.1.454.CMB.1.raw
  modified_base (297)..(297): a, c, t, g, unknown or other
  misc_feature (297)..(297): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagagacagagtcacatcacttgcggcagtcagggtattagcagctggttagcctggtatcagcaagaaaccgaggaacgccctaaagcctaccngactctatggtgcatccgtagtttaggaaacggtcggggtacccaacggtaaacggttcgaacggccggtacgtaaggttacgaaacgttcgtaggggtaacctaggtaaactttttccgaacctttcccttacccgaaaccctaacttacccgaaacggtccgtaaaccgtccgttcggaacccgtaacggtaccccgttagggttaaaccgttacgttttttaccggaaccttaaaaccgttttaccgttaagtttaccggtaacctaaaaccgtacgggtacctttaaaccgttaccgtttttccccctaacgttaccgttaacccgtttccggggaccgggtaacgggtaaccccgtaaagggttacgtaacgtaacgttaaccgaaaacggtacgttacgggtcgtaaccgtacggtacctaccgttacg

SEQ ID NO: 101776 - DNA, 588 bp, Homo sapiens
  misc_feature: GYAE6OF02FIO6U.15.71.G05.1.454.CMB.1.raw
  modified_base (324)..(324): a, c, t, g, unknown or other
  misc_feature (324)..(324): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttggtccgggcgagtcgagggttattaagcagtctggttagccgttggtatcagcaagaaaaccgagggaaacgcccctaagctcctgactctagtggtnctatcctaggttaggaaaggtcgggtacccaacgtaaggtcaggcggatacgtagagtcgtgggatagtactttcactctacacctatacgagcacgctcgacacgtccgtagtacggttatttcgacttaacttactagttcgactaacgagtactaacgttaccgtttccctacgttaccgttacgtttcgggaccgggtacgggaaccgtagggtaggtactaagtacgaaacgtacgttcgagggtactcgtacactacg

SEQ ID NO: 101777 - DNA, 953 bp, Homo sapiens
  misc_feature: GYAE6OF02F0VWN.15.71.G05.1.454.CMB.1.raw
  modified_base (164)..(164): a, c, t, g, unknown or other
  misc_feature (164)..(164): n is a, c, g, or t
  modified_base (216)..(216): a, c, t, g, unknown or other
  misc_feature (216)..(216): n is a, c, g, or t
tcagtctacgtagccacgaccggtgctcgatttagtgtcgtcgcaagagagaggggttcaggctggaactgaggagcaggtgggggcacttctccctctaacactcctccccgctcagctcctggggcctcctgctgctctggttcccaggttccagatgcganactccagatgagccagtctcatcttccgtgtctgcatctgtaaggagacagngtccacatcacgttggcgggcacgtagagggttattagcgagtcgttaggttacggtacccgttaggtactaccgaaggaccgaaacggaaaacccggtaaggggaaaacccggtcccccgtaaacggtccctacccggtagtacgtacgtaagttcggtacggactacgtaaccggttaaggttttaaggggaaaaccgggttaccggggggttaaccccctaaaccgggttaaacggggttttacccgaaacggggtcccgggtaacggttaaacgggttaacgggtaaaacgtttaccgggttaaagggggtaaacccgttaaacgggttttaccttttaacccgtaacccgtttaaccccttaaaccctaaacccgtaaccgttaaccgtaaacgggtaacccgtaacggtaccccgtttacggtaacccgtaaccggttaacccggttacgggtaacggttttacgttttaacccggaacctttaaaacgttttaaccgttaacgtttaacggtaaaccctaaacggttaaccgtaaccgtttaaacccggtttacccgtttttaccccgtaccgtttaacccgtttccggttaaccggggacccggggttaaacgggtaaccggttaaaccggggtttaaggtaaaccttaaaccggttaaaccgtaaaaaccggttacggtttaccggttacgggtaccgtttaaccgggtaacccttaccggttaaccg

SEQ ID NO: 101778 - DNA, 732 bp, Homo sapiens
  misc_feature: GYAE6OF02IUBXC.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctcggttcccaggttccagatgcgacatccagatgagccagtctccattcttccgtgtctgcacttcgtggtaaggagacagacgtccaccatccacgttggccgggcgtacggtcgaggggttattacgacgagtcgttgggttacgccgttaggttactcgacgacgaacgaaaccgacggaaaccgcccctaagcctcgtagacttcgtagtcggtcgactacgttcgtaaggtttaggaacggttccgggtaccctaacgtaacgggttcgacggccggacgtacgtacggtaacgttcggacgggtactaaggttactttaccgaccttccgtaccgtaaccctacgtacgacgtccgacgtacccgtacgccgtaaccgtcggttaacggtacggttttacgttttacgaaccttttaaaccgttacgttacgttacgtaaccgtaacggtaacgttaccttaaccgtttaccgtttacccttccgttaaccgttccggttaccgggacggtaaccgggtaacgtagggtaccgtaagtaaccgtaaccgaaacgttacgtcggtacggtactacgtaccctacttacg

SEQ ID NO: 101779 - DNA, 754 bp, Homo sapiens
  misc_feature: GYAE6OF02HNPQK.15.71.G05.1.454.CMB.1.raw
  modified_base (252)..(253): a, c, t, g, unknown or other
  misc_feature (252)..(253): n is a, c, g, or t
  modified_base (265)..(265): a, c, t, g, unknown or other
  misc_feature (265)..(265): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctcctgctgctctggtcccaggttccagatgcgacatccagatgacgccagtctcattcttccgtgtctgcatctgtaggagacagacgtcaccagtcacgttggtcgggcagtcgagggtattagnngtactggttacncctgtactcagacaagaaaccgaagggaaacgacccctaagtccgtacctagactcgtagtaggtcgacgtacttccgtaggtttagggaaacggtccggggtaacccctacggttaacgggtttcgacggtaccggtacgtaggttaacgtaacgttcggtaaggggaacctaggtaacttttaccgtaccttaccgtacccgtaacccgtgttaaccgacgtaccgaccggtacccgttcggaacccgtacggtaaccggttacgggtaacggttttacgttttaaccggtaacgttttaaaccccttttaaggtttaccgtttaacggttaacccgaaaacgttacggggtaacccttttaaacgttccgttttaaccccgtccgttaacccgtttaccggtttacgggaccggttaaacgggtaccgtaagggttcgtaaacgtacgtaacgtaaacgtgtacggtggtacctcgacgtacgtac

SEQ ID NO: 101780 - DNA, 683 bp, Homo sapiens
  misc_feature: GYAE6OF02G2DDU.15.71.G05.1.454.CMB.1.raw
  modified_base (326)..(326): a, c, t, g, unknown or other
  misc_feature (326)..(326): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccattcttccgtgtctgctatctggtaggagacagagtcaccatcacttggtcgggcgagtcagggttattagcagtcgttggttacgccgttggtatcagacaagaaaccgagggaaacgccctaagcctacctgactacttagnggtcgctagtccgtaaggtttacgggaaacggttccggggtacccctaaacggtaagggttcgacgggtacggacgtaaggtacgtaaacgttccggtaggggtaacgtacgttacttttacccgacctttaccgacctaaccctagtaccgactcgtacggtacccgtgaccgtacggtcccgttagggtaacgggtttctttacgaccttaaaccggtttattacgtttacgaacctaacggacgtaaccttaacgttaccgtttcccttactaccgttacgttcgggaccgggtaaggaccgtagggtaacgtactaacgtaactaacgtgtaccgtagctacgtaccactacg

SEQ ID NO: 101781 - DNA, 758 bp, Homo sapiens
  misc_feature: GYAE6OF02IGR73.15.71.G05.1.454.CMB.1.raw
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctggtaganacagtatcacatcacttggtcgggcgagtcgagggttattagcgtagtcgttggttacgccgttggtactcgacgacgaaacggaaaaccgtaaacggggaaaaccgtacccccgtaaaggtcccgttaccgtagtaacttcttaaggtcggggtctaccctaacgtttcccgttaagggttttaacgggtaaaacgggtcgggggttaaccccgtaaaccgggtaaacggtttccggaacggtccggaacgttacggtaacggtaaacttccgggtaaggggaaccgtaacgtttaacgttttccaacccggtttcctaacccgtaacccgtactacggaacgtcgtaaccgtccgttacgacctacggtccggttaagggtacgtttaagtttcgaaccttaaacttacttagttacgtaacaacgacgttacctaaacgttccgtttacctcttacccgtacggttcggaccgggtaacgggtacctaagggtacgtaactaccgtaacgaaaccgtgtacggttacggcctaacggtccacttacg

SEQ ID NO: 101782 - DNA, 706 bp, Homo sapiens
  misc_feature: GYAE6OF02H7972.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgacgccagtcctccatcttcgtgtctgcatctgtaggagacagacgtacaccatctacgttggcgggcgtagtcgaagggttattagcagtcgttgggttacgccgttggtatcgagacaagaaaccgaagggaaaccgtacccctaaagtcctaccgtaggtacttacgtagtcgggtacacctaacgttccgttaaggtttacgggaacggttccggggtaccccaaacgtacggttcacggcggacgtaagtacgaacgttcggacggtaactacgtacttttaccacttcctaccgtaacctctacgaacgaccgtacgccttacggaccgtacggtccgttaaggtaacggtttcgtttaccgaacgtttaaacctttacttacgtttagtaacccgtacgaacggttaaccttaacccgtttacctttccctaacgttccgtaccgggtttccggaacgggtacggtaacgtagggtaactacgttaactaaccggtaagtctcgggtacgcgtacgtacctacgttacg

SEQ ID NO: 101783 - DNA, 818 bp, Homo sapiens
  misc_feature: GYAE6OF02HLXZP.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctgggctcctgctgctctgtcccaggttccagatgcgacatccagatgagccagtctcattcgttccgtgtctgctatcgtgtaggagacagacgtcaccatctacgttggtcgggcgtagtcgagggtattagactagtacgttggttacgccgtggtactgacggtacaacggaaaaccgaagggaaaccgaccccgtaagtccttaccgtaggtacttacgtaaggtcggtacgacgtacttaccggttaaggtttaacgggaaacggttccggggtaaacccctaacggtaaacggtttccggaacggtcggtacgtaacggtaagtaacgtcggtagggaacctaggttaactttaccgtacttcctaccgaacctacgtacgaacgttacaccggttccctaggaccgtacgttacccgttaaggggttacttttacggttttacccgtaaacgttaaaccgtttactttaacggtttaccgtaaccgtaaaccggttacgtaaacctttaacccgtttacccgtttaccccgttacggttaacccgtttacccgggtttaccgggaccgggggttaaaccgggtaacccggtttaaagggtccgggttaaaccttaaccggttaacccggtaaaacggtttacggtacgggttacggttacccggtacgtaacccggtaaccctttccggg

SEQ ID NO: 101784 - DNA, 680 bp, Homo sapiens
  misc_feature: GYAE6OF02I7457.15.71.G05.1.454.CMB.1.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtagganacagngtcacatcacttgcgggcgagtcgagggtattagcagctggttacgctggtatcagacagaaaaccgagggaaacgcccctaagcctccgtagactctagtggtacgctactccgtaaggtttagggaaacggttccggggtacccaaccgtaaggttccacggcgggacaggtagaagttcgtagggacagttactttcgaccttacacctacctacgtacacgtcacgtccgtgaccacgccgttaggtacgttacttttacgaaccttaaacttagttacttaccgtaacgtaaacgtaacggtaaccttaaccgtttaccgtttccccttacgttaaccgtaccgggttttaccgggacgggtaaccgggtaaccggtaacggggttacgtaacgttaacccgtaaacggtaaaccggttaacgttcgggtacggtaccgttacgtaccttaaccgtttacgg

SEQ ID NO: 101785 - DNA, 715 bp, Homo sapiens
  misc_feature: GYAE6OF02IAMTF.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctccccgctcagctcctggggctctgctgctctcggttcccaggttccagatgcgacatccagatgagccagtcctccatcttccgtgtctgcatctggtaggacgacagacgtccacctatctacgttcggcgggcgagtcgtaggttattgcagtcgtaggtacgccgtaggtactcgagacaacggaaaccgaagggaacccacccgtaagtcctaccgtagtacttcgtagtcggtacgacgtacgttacgttaggttacgggaacggtccgggtaacccacgtaaggtcgaggcggacgtaggtacgtacgtcggtacggggactaggttactttaccgacttaccgtaccgtaacctacgtacgacggtaccctgtcccgtacggcgtacggtccggttaggtacggtttacttactaaccgtttaacttaacttacgttaacgtaaccgtaacgtaacggttaaccttaacctttaccggttcccttacgttacccggttacgggtttaccggggaccgggttaaacgggtaccgggtaaggtacggtaaactaccgtaacgaacggttcgtacgggtccgtacggtcacccgttacttacg

SEQ ID NO: 101786 - DNA, 724 bp, Homo sapiens
  misc_feature: GYAE6OF02F2LVA.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagcctcctggggctcctgctgctcttggttcccaggttccagatgcgacatccagatgagccagtctccattccttccgtgtctgcatctgtaggagacagagtcacctactctacttggtcgggcgagtcgagggtattagcagcgttggttagccgttggtactcgagacaacggtaaaaccgaagggaaaacgaccccctaagcctaccgtagacttacttaagtgggtacgacctacgttaccgttaggttttaagggaaaacgggttccgggggttaccccaaaccggttaaagggtttccgaacggccgggtacgtaacggtagtaaacgttccggttacggggaactacggtacttttacgacctttacctacccaactacgtaccgacgaccgaccgtccgtacgaccgacgtccgtaaggtacgtttacgttttacgaacgtttaaaccttattacgtttaccgtaacgaaacgtacggttaacctaacgttaccgtttcctctacgtttaaccgttccgggacgggacgtaaccgggtaggtaaggtactaacgtaaccgtaaacggtacgttcggtaggccgtacgtaccacttaccg

SEQ ID NO: 101787 - DNA, 595 bp, Homo sapiens
  misc_feature: GYAE6OF02F0C81.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagacagaaaccgagggaaacgcccctaagcctcctagatctagtggtgcactcctaggtttaggaaaggtcggggtacccaacgaaggttcagcggacagtagaatcgtagggacagtactttcacttcacaccatcgagcagcctgccacgtcctggagttatttacgacctaactttacttattcgtaacaacgtagtacttaacgttacgttttccctacttacctaccgtttcgggacgggtaacgggtaaccgtaagggtacgtaacgtaacgttaaccgaaaacgttacgttcggtacgggtacctacgacctaacctacg

SEQ ID NO: 101788 - DNA, 602 bp, Homo sapiens
  misc_feature: GYAE6OF02F3WJJ.15.71.G05.1.454.CMB.1.raw
  modified_base (468)..(468): a, c, t, g, unknown or other
  misc_feature (468)..(468): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtccacatcacttggtcgggcgagtcagggttattagcagcgtggttacgcctggttatcgagcgaacgaaaccgaacggggaaacgaccccgtaaaggcctaccgtaggtattcctagttcgggtagctacgtccgtaaggtttagggaaaacggttcggggtaccccaacgtaaggtttcgaacggccggacgtagtacgaacgtcgtagggactagtactttcactctacaccatcacgcacgcctggaccngtcctagagttctttagactaacttctattgtacgactagtaccttaattctttaccctctcgtacgttcggacggtacggacgtaggtagtaatacgtaacgtaaacgtacgtggtagtactgtaccacgtag

SEQ ID NO: 101789 - DNA, 639 bp, Homo sapiens
  misc_feature: GYAE6OF02G2EWC.15.71.G05.1.454.CMB.1.raw
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatcgtgtaggagacagagtccaaccatctacgttggtcgggacgagtcgaagggttattagctagcgtaggttacgccgtggtatcagacaacgaaaccgaagggaaacgcccctaagtcctacctaggacttactagtcggtcgactatccgtagtttacggaaacggtccgggtacccacgtaaggtcacggcganagtagagtcgaggacaggtacttcgactctacaccagtcagcacgtccngaccgacgtcgtaggtacgttactttagacctttaacttacttagttacgaccgtaaacgacgtacctttaaccgttccgttttaccctcgttaccgttaaccggtttccgggaacggtaccgggtaaccgtaagggtacgtaacgttaacgaaccgtaaacgtaacgtcggttacgaccgtacacgtaacctcg

SEQ ID NO: 101790 - DNA, 716 bp, Homo sapiens
  misc_feature: GYAE6OF02GL97D.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctgggctcctgctgctctcggttcccaggttccagatgcgacatccagatgagccagtctccatccttccgtgtctgcatctggtaggagacagtacgtcaccatacctacgttggtcgggacgtagttcgaagggttatacgcagtcgttggttacgccgttaggtactcgagacaacgaaaccgaaggaaacgcccctaacgccgttaccgtagacttactaggtcggtctactacgttaccgttaaggtttacggaaacggttccggggtaaccccaacgttaacgggttcgaccgggtccggtactaagggttacgtaaacgtccggtaggtaacgtagtttaccgtttacgtaccttctaacccgaccttacgtaccgaacgtccgtacgtcccacgtccgaaccgttccgtaagggttacgtttacgttaccgtaaccgtttaaccttacgttattacggttaaccaagtacgaacctttaccgtaccgttccctacgtccttaagggtccgtagggaaccggtacgtaaaggtcgttaaacacggttaccgaaacgtacttcggggtactccgaccttagacccttacg

SEQ ID NO: 101791 - DNA, 844 bp, Homo sapiens
  misc_feature: GYAE6OF02GOS67.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtcctccattcttccgtgtctgcatcgtagtaggagacagacgtccacctatcctacgttcggtcgggacgaggtacgtagggttaattagcgtagtacgttcggttacgtccgtaggtactacgaacgacgaacggaaaccgaacgggtaaacccgacccgtaacgcctaccgtacgtaacttacgtaggtacggtacgtactagttaccggttaagggttaacgggtaaaccgggttcccggtaaccgtaacggtacggtacggtacggtacggtacgtaacggtagtaacggtcggtacggtacgtagttacgttaccgaccttacccgttaacgacctagtaccgtccggaactaccggtacccgacgtacccgttagggtaccgtttaacgggtaacttttaaccgggtttaaccttaaaccttaccgttttaaggtacgttaaaccccgtaaccgttaaaccgtttacccggtttaaaccctttacccgggttttaccctttacccccgggttaacgtttaaacccggggttacccggggtaaccgggtaaaccgggggttacggtaaccggttaaagggttaacctaaaccggtaaacccgtaaacggttaccggttaggaccggtttaccgaacccgtttacccgatttaccccgttacg

SEQ ID NO: 101792 - DNA, 827 bp, Homo sapiens
  misc_feature: GYAE6OF02HESCE.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgacgccagtcctccatcttcgtgtctgcatctggtaggagacagacgtcaccatactacgttggtcgggacgtaggtacgagggtattacggctagtcgttgggttacgccgttaggtactcgaggaccgaacggaaaccgaacggggtaaaccgacccctaagtccttaccgtaggtactacgttacggtggtacacgtacttaccgtaaggtttacgggaacggttccggggtaacccaaccggtaacgggtaccgtacggaccggtacgtaaaggtacggtaacgttaccgggagggaacctaggttaccttttcgaacctttccgtaccgtaccctaacgttaccgacgtaccgtaacgtcctaccggtacgtaccggtcgttacgggtaacggtttacgtttaaccgtaaccgttaaaccgtttacgtttacgttaccggttaaccgtaaacgggtaaccgttaacgtttaaacccgtttacccgttttaccccgttaccgtttacccgttaaccgggttttacccggggaacccggggtaaccgggtaacccgggttaaagggtaccggttaaacgttaaaccgtaaaccggtaaaccggttaccgttacgggtaccggttacggtaacccgtaccggtacccgttaaccg

SEQ ID NO: 101793 - DNA, 607 bp, Homo sapiens
  misc_feature: GYAE6OF02I0HRH.15.71.G05.1.454.CMB.1.raw
  modified_base (174)..(174): a, c, t, g, unknown or other
  misc_feature (174)..(174): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (532)..(532): a, c, t, g, unknown or other
  misc_feature (532)..(532): n is a, c, g, or t
  modified_base (594)..(594): a, c, t, g, unknown or other
  misc_feature (594)..(594): n is a, c, g, or t
  modified_base (602)..(602): a, c, t, g, unknown or other
  misc_feature (602)..(602): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctcgtggttcccaggttccagatgcgacatccagatganccagtctccatcttccgtgtctgcatcgtagtaggagacagagtcacatcacgttggtcgggcgagtcgaggtattagcagcgttggtacgctaggtatnagcaagaaaccgagggaaccncctagcctctagattactgtggtcgactagtaccgtaggtttacggaaaacggtccggggtacccaaccgtaaggtcacggtacggtcaaggtttacgaacgttcgtaagggaaacctggtttacttaccgacttacgtaccgactactacgcgacgtacgctacgactcgtcgagttaggttagttacgacttaacttacttatccgttacacgtacgtacgtactaccgtttccncttacgtacgttacggacggtaacgacgtaggtacgtagtaacgtaacgacgagtgtacgtntacggacngtaac

SEQ ID NO: 101794 - DNA, 732 bp, Homo sapiens
  misc_feature: GYAE6OF02FTKZC.15.71.G05.1.454.CMB.1.raw
  modified_base (155)..(155): a, c, t, g, unknown or other
  misc_feature (155)..(155): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctctgctgctctggttcccaggttccagntgcgacatccagatgagccagtctcctatcttccgtgtctgcatctgtaggagacagacgtccacctatctacgttcggtcgggcgtacgtcgagggtattagcagtgtaggttagcctggtatcagtacaacgaaaccgtaagggaaaccgaccccgtaaaggcctcctaggtacttcgtaagtggtacgactactccgttaaggttaggtaacgggtcgggtacccaacgtaacggttacgacggtacgggtctaggtacgtaagtcgtacgggtacgtagttacgtttaccgtacttccgttaacaccctataccgacgaccgtaacgtcccgttagcccggtacgtacgttggaacgtttaccgtttacggaacttaaccgttttaattacgttacgtaaaccgacgtacgttaaccgtactttaacccggtttacctaccttccgttacggtttccggaggggtaacccgggtaacccgttaagggggtacgttaacgtaaccggttaaccgtaaaagggtcccggtttaacgggtccggttaaccgtacggttacccgacccgtttaacgg

SEQ ID NO: 101795 - DNA, 803 bp, Homo sapiens
  misc_feature: GYAE6OF02ISXX1.15.71.G05.1.454.CMB.1.raw
tcagtctacgtagccacgaccggtgctcgatttagtgtcgtcgcaagagagagggggtcaggctggaactgaggagcagggtgggggcacttctccctctaacactctccccgctcagctccgtgggctcctgctgctctcggtccctaggttccagagtgcgacatccagatgacgcctagtctccattcttccgtgtctgctatcgtaggtacggacgacgaacggtacgtaccaaccctacgttacgtaacgttcgggtaccggggtacgtaaggtacgtaacgggttaagttacgaccggtaagtcggttacggttaacgtccgttaggtacttacgacgacgaaacgtaaaaccggacgggaaacctacccgaatccgtacgtagtactacgtagtcggtactacgtattacggtaaggttaggaaccggttccggtaaccctaacggtaaggttcgaacggtcgtacgagtacgtaagtcggtaaggactattactaccgcgtactacgtaactacggtaacacgtacgaacgtcgtacgaccggtaaacgtcggttaagtaacgtttaacggtttacccgaaatttaaaccctttagtacgtttaaccgtaaaccgtaaacggttaccgttaaacctttaacccggttactttttaccccggtacttaacccggttaccggggtttacccgggaacggtaacccgggttaacggtaaacggtaccggttaactaaccgtaaacgtaaacccggtaggttaccggtaccgtacgggtaccccagtaacccggtttac

SEQ ID NO: 101796 - DNA, 783 bp, Homo sapiens
  misc_feature: GYAE6OF02IQXA5.15.71.G05.1.454.CMB.1.raw
  modified_base (215)..(215): a, c, t, g, unknown or other
  misc_feature (215)..(215): n is a, c, g, or t
  modified_base (265)..(265): a, c, t, g, unknown or other
  misc_feature (265)..(265): n is a, c, g, or t
tcagtctacgtagccacgaccggtgctcgatttagtgtcgtcgcaagagagagggggtcaggctggaactgaggagcagggtgggggcacttctccctctaacactctccccgctcagctcctggggctcctgctgctctggttcccaggttccagatgcgacatccagatgagccagtcctccattccttccgtgtctgacatcgtggtagganacagacgtcaccatctactggtcgggacgagtacgaggtattaggcaggngtaggttacgcgtgtatcgagacgaagaaaccgaacggaacgtaccccgtaagtcctacgtagtatacgtaggtcgtcgactacgtacgttaaggtagggtaaacggttccggggaaccctacgtaacggttcggacggccggtacgtaagtacgtaacgttacggtacgggtaactaacggtttactttaccgacctacccgtacgtaacccgtacggtaccaacggtaccgtaacgtccgttcgggacgtaacccgtccggttaagggtttacggttacttttacgtaacccgtttaaaccttaacgtttacgttacggttaaacccgaaccgtaacggggttaaaccttttaaccgttaacccggtttttccgttaaacccgttaccgtttacccggggtttacggacccgggggtaaacggtaccggggttaaacggtaccggttaactaacgttaaacccgtaaaccggttacggttcggtacccggaacgtttaccgaacgtacctttaacg

SEQ ID NO: 101797 - DNA, 739 bp, Homo sapiens
  misc_feature: GYAE6OF02F5W0O.15.71.G05.1.454.CMB.1.raw
  modified_base (213)..(213): a, c, t, g, unknown or other
  misc_feature (213)..(213): n is a, c, g, or t
  modified_base (471)..(471): a, c, t, g, unknown or other
  misc_feature (471)..(471): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgacgccagtcctccattcttccgtgtctgcatcgtggtagganacgagacgtccaccatctacgtttggcgggacgagtcgaggggttattagcgagcgttggttacgccgttggtatcgagacaacggaaaccgaaggggaaacccacccgtaaggcccttaccgtagtaccttcgtagttcggtagacctacgtccgttagggtttaacgggaacgggttccggggtaccctaaccggtaacggtttacgacgggtcggacgtaggtagtagttcggtagggaactaggttactttacncttccgaccactaagcctacgacacgtccgagtaccgacgtccgttaggtacgtttactttcgaacctttaactttacttagttacgtaacgaaccgttacgtaaaccgttactttaccggttttaccctacgtttaccgtttaccgggttaccggggtacggggaaccggttaaccgggttaaagggtaccggtaaacgttaaccgttaacccggtaacggttaaccggttcgggttaacggacccgtacggtaccctacggttacg

SEQ ID NO: 101798 - DNA, 578 bp, Homo sapiens
  misc_feature: GYAE6OF02FWSNQ.15.71.G05.1.454.CMB.1.raw
  modified_base (315)..(315): a, c, t, g, unknown or other
  misc_feature (315)..(315): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagacgtcaccatcacttgtcgggcgagtcagggtatagcagctggttagcctggtatcagcacgaaaccgagggaaacgccctaagcctcctgactctagtggtncactcctagttaggaagtcggggtcccacgtaggtcaggcgcagtgaatcgtagggacagtactttcactctacacctatcagcacgcctgccacgccgttaggaggttacttttcggaactaactttactaagttcgactaacgacggtacctaacgttacgtttccctcttactacgtttcgggacggtacgggtaaccgtaagggtggtaactaacgtaacgtaaacggtacgttggtacgtcctacgtaccgtactacg

SEQ ID NO: 101799 - DNA, 715 bp, Homo sapiens
  misc_feature: GYAE6OF02F1ZLE.15.71.G05.1.454.CMB.1.raw
  modified_base (211)..(211): a, c, t, g, unknown or other
  misc_feature (211)..(211): n is a, c, g, or t
  modified_base (279)..(279): a, c, t, g, unknown or other
  misc_feature (279)..(279): n is a, c, g, or t
  modified_base (335)..(335): a, c, t, g, unknown or other
  misc_feature (335)..(335): n is a, c, g, or t
  modified_base (383)..(383): a, c, t, g, unknown or other
  misc_feature (383)..(383): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctcttggttcccaggttccagatgcgacatccagatgagccagtctccatcttccgtgtctgcatcgtagtagganacagacgtacacctatcacttggtcgggcgtagtcgaaggttattagcagcgtggttagcctggtacncagtacaacgaaaacgtagggaaacgacccgtaagctccgagtacgtactagtggngactactcgtagttacggaaggtcggtaccaccgtagtacgagacggntacgtgaacgtcgtagggactaacggttctttacgactactaccaacgtataccgacgcgaacgtccgttcgacctacgaccgtagggttaacgttacgttttacgaaaccctttaaacttttaacttaacgtttaagttaaccgaaaacgttacgtaaaacccttaaaccgtttaaccgtttaccctttaaccttaaccgggttacgtttaccgggggaccgggtaaacgggtaaccggtaaaacgggttaaggtaaaacgttaaacgtaaccgttaaaaaccggacgtttacggggttaacgtaacggtaccgtaccctaacggttaacc

SEQ ID NO: 101800 - DNA, 652 bp, Homo sapiens
  misc_feature: GYAE6OF02HZFQB.15.71.G05.1.454.CMB.1.raw
  modified_base (218)..(218): a, c, t, g, unknown or other
  misc_feature (218)..(218): n is a, c, g, or t
  modified_base (351)..(351): a, c, t, g, unknown or other
  misc_feature (351)..(351): n is a, c, g, or t
tcagtctacgtagccacgaccggtgctcgatttagtgtcgtcgcaagagagagggggtcaggctggaactgaggagcaggtgggggcacttctccctctaacactctcccccgctcagctcctggggctcctgctgctctcggttcccaggttccagatgcgacatccagatgagccagtctccattccttccgtgtctgctatctaggtaggacganagtacgtaccactatctaacgttggcgggacgtagtcgtaagggttattacgcgtagtcggttaggtttacgcgtaggtatcgagacaacgaaaccgaggaacccaccctaagcctcgatatacgtagtggtnacgtactacgtaggttaggaacggtcggtaccacgttagtcgacgcggtactaggtactagtcgagggactagtactttcatccactactactacgacgtacgacgccgtacggacacggttaccgtaggtagtttaacctttacgtaacttaaccgtttactagttacgaacgtaacgacgttacctacgtttaccttccctagtaccgtacggttcggacgggtaccgtaacggtaaggtacgtaactaacgtaaccgtacggttaacgtcggtaggtacccgagtaccctagttaccg

SEQ ID NO: 101801 - DNA, 755 bp, Homo sapiens
  misc_feature: GYAE6OF02IFAR9.15.71.G05.1.454.CMB.1.raw
tcagtctacgtagccacgaccggtgctcgatttagtgtcgtcgcaagagagagggggtcaggctggaactgaggagcagggtgggggcacttctcccctctaacactctccccgctcagctccgtggggctcctgctgctctcggttcccaggttccagatgacgacactccagatgagccagtcctaccattccttcgtgtctgacattcgtggtaggagacagactacactatctacgttggtcgggcgagtcgaagggttattagctaggtcgttaggttacgtcgtaggtatacgaaggacgaaacggaaaacccgtaagggaaacccgaccccgttaaacggtccttaccgtaggtactttacgtaaggttcgggtacgtacctacgtttacgtaaggggtttacgggaaaaccgggttccggggtaaacccctaacggttaaggtacgacggcggtacgtagtacggtaagtacgtacgggtactaaggttactttaccgaccttaccgtacctaaccctaagtaccgtaagacccgtacgtaccgtcggacgtaccgttacggttaaggtacgtttatttaccgaacttaacttaacgtagttacgaacacgtacgttaaccttacttaccgtttcccacgttaccgtaccgggttccgggaacggtacgggaacgttagggtaacgtaacgttaacgtaaaccgtaaacggtagttgggtaaccgtaccgtacgaccttacctaacg

SEQ ID NO: 101802 - DNA, 615 bp, Homo sapiens
  misc_feature: GYAE6OF02G6L76.15.71.G05.1.454.CMB.1.raw
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacgttgtcgggcgagtcagggtattagcagctggttagcctggtatcgagcagaaaccagggaacgcccgtaagctcctgactctagtggtncatacctaggtttaggaaggtcgggtcccgaaccgaggttcgagcggngagtgaactcgtagggactagtactttctacctcgtaccaccgatcgacgacgtacgcctagccgacgccgttagtaggtacttttacgaccgtaactttacgttattcgtactaacgtacggtacttaaccttaccgttttccctacgttaccgttacgtttccgggacgggtacggtacccgtaagggtaggtaacgttactaaccggtaaacgacggtttaggaccggtacgtcggaccctaccgttacg

SEQ ID NO: 101803 - DNA, 811 bp, Homo sapiens
  misc_feature: GYAE6OF02HQF76.15.71.G05.1.454.CMB.1.raw
  modified_base (211)..(211): a, c, t, g, unknown or other
  misc_feature (211)..(211): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatccttccgtgtctgcatcgtagtagganacagacgtccaacatcacgttggtcgggacgaagtcgtaaggggttattagcaaggtcttagggtagtaccgtggttaactcgaacgaccgaagaaaaacccggaaggggaaaaccgacccccgtaaaagtcccgttacccgtaggacttacgttaacgtggggttacactaacgttacccgttaagggttttaacgggaaaacgggtttccgggggtaaccccaaaccggttaaacgggtttacgaacgggtaccggggactaaggtaaggtaaacgttacggtacggggaaatacggttaacttttaccgaacccttctaaccctaaccgtaactcgaaacggtaccaaaccgtcccgttacgaccggtacgtacccggttaggtaaacgggtttacgttttaacgaaccgttaaaacttttaaccgttaaagttacgtaacctaacggaacgttaccgtaaaaccgttccgtttacccgtactaccgttaccgttacgggaccgggtaggtaaacccggtaagggttacgtaacggtaacgtaacccgaaaacggttacgacgggttcggtaaccgtcggaccccgtaacctaccgg

SEQ ID NO: 101804 - DNA, 813 bp, Homo sapiens
  misc_feature: GYAE6OF02I9MLO.15.71.G05.1.454.CMB.1.raw
  modified_base (173)..(173): a, c, t, g, unknown or other
  misc_feature (173)..(173): n is a, c, g, or t
tcagtctacgtagccacgaccggtgctcgatttagtgtcgtcgcaagagagagggggtcaggctggaactgaggagcaggtgggggcacttctccctctaacactctccccgctcagctccgtgggctcctgctgctcgtcggttcccaggttccagatgacgacatccaagntggacgccagtcctacctattccttccgtgtctgactagttctaggtaggacagagtacgaccaacctatacgtacgttcggtacgggacgtagtacggtaagggtattacgacgtagtcgttacggttacgtccgttaggttacacgagaacaacgtaaaaccggaggggtaaaaccctccccgttaaagtcccgttcctaaggtacttaccgttaggtcgtacgtacgttaacttccggttaagggtttaacggaaacgggttccgggtaaccccctaaggttaacggttccgacggggtacgtaccgttaaggtaacgtaaacgtcggggtaggtaacggtacgtactttaaccgacgtaccgtaacgtaccgtaacgttacgacggtacctaccggcgttacgaccgtacgtaccgtacgttaggttaccgtttacgaaccttaacgtttaccttaagttacggtacctaacggtaaccgttacgttaaacccgttccgttttccgacgtttacccggtaccggtttacgggtaccggggtaaacgacccgggtaaaggttacggttaacgtaaaccggtaacgttaaaccggcggttacggttccggtacccgtacggtaacccgtacggttacc

SEQ ID NO: 101805 - DNA, 692 bp, Homo sapiens
  misc_feature: GYAE6OF02FU6Y5.15.71.G05.1.454.CMB.1.raw
  modified_base (208)..(208): a, c, t, g, unknown or other
  misc_feature (208)..(208): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttccccaggttccagatgcgacatccagatgagccagtctccatcttcgtgtctgcatctgtagganacagagtccaccatcacttgtcggggcaggtcagggttattagcagctggttagccttgggtatcgacgcgtaacggaaaaccgtagggaaacgaccccgtaagcctaccgtgactctagtcggtgtcacgtcctaggtttacggaaggttcggggtaccctaacgtaaggttcaggcggacgtaggtgtaacgtcgacgggtaaccaggttacttttaaccgaccttacctaccgtaacctaacgttccgacgtacgtacgtaccgtacggacctagacccgttggtacgggttaactttcgaaccttacttttaacgtcttacgtactaaacgtacggtacctaacgttacgttttcccctacgttactaccgggtttacggtcggggtaaacggaccgttaaaggggtcctaaaccgttagtaaacccgtaaacggttaacggtacggttaccggtacgtccgttaccgtaaccgttaccg

SEQ ID NO: 101806 - DNA, 666 bp, Homo sapiens
  misc_feature: GYAE6OF02F44BC.15.71.G05.1.454.CMB.1.raw
  modified_base (212)..(212): a, c, t, g, unknown or other
  misc_feature (212)..(212): n is a, c, g, or t
tcagtctacgtagccacgaccggtgctcgatttagtgtcgtcgcaagagagagggggtcaggctggaactgacggagcaggtgggggcacttctccctctaacacgtcctccccgctcgagctcctggggctcctgctgctctggttcccaggttccagatgcgacatccagatgagccagtctccatcttccgtgtctgcatctgtagganacagagtcaccatcacttggtcgggcgagtcagggtattagcagctggtagccgtggtatcagacaggaaaccagggaaacgcccctaagcctacctgactactagtcggtcgcacgttcctaggtttaggaaacggttcggggtacccaacgtaacggttcgaacgtcggactacggtagaacgtcgtacggggactagtacttttccgaacttccgtaccaccatcacgtacacgccttgacctagccgttagagttattttcgacttaactttactagttcgtacaacgtacgtaccttaacgtaccgttttaccctacgttaccgttaccgtttaccgggacggtaaccgggtaaccgtaacggggttaacggtaacttaacggtaaacccgtaaaccggttaacgttacgggtaaccgggttcgtaacccggttacctaccgttaaccg

SEQ ID NO: 101807 - DNA, 732 bp, Homo sapiens
  misc_feature: GYAE6OF02GJ715.15.71.G05.1.454.CMB.1.raw
  modified_base (355)..(355): a, c, t, g, unknown or other
  misc_feature (355)..(355): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctggtaggagacagagtcacctatctacgttggtccgggcgagtcgaagggtattagcgagcgttggttacgccgttggtactcgaggacctaacggaaaaccgaggggaaaaccgtccccgtaaagccttaccgtggaacttcgtaggtgggtcnctacgtccgtaaggtttacgggaaacggttccgggggtacccaacggtaaacggtttcgacggccggtacgtaaggtacgtaacgtccggtaggggtaacctaggttaacttttccgaaccttaccgtacccaaccgtactccgtaacggcaacggtcctacgacgacgtccgttaggagtttacgtttcgacttaacgttacttagttacgtaaccgtaacgtacggttaaccttaaccgttaccgttttccccgttacgttaccgttaccggtttacggggaccgggtacgggtaaccggtaagggttaacggtaacttaacggtaaccgaaacggttacggttcggtaccggtcgtacggtacctaccgttacg

SEQ ID NO: 101808 - DNA, 796 bp, Homo sapiens
  misc_feature: GYAE6OF02IL1R7.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctcgtcggttccctaggtccagatcgcgacactccagatgacgcctagtcctacctattccgtttccgtcgttactcgactacttcgttaggtaacggagacagtacgtaccaacctacttacgtacgtttcgggtaccgggacgtaggtaccggtaagggtttacttacgacgtaggtacggtttaggttaccgtaccggttggttaacgtacgaacgacgtaaaccggaaaaccggaacgggaacccgtaaccccgtaagttcccgtacgttacgtacgttaccgtacggttacggtcgtacctacgttaccgttaacgggtttacgggttaaaccgggttaccgggtaaccccgtaacggttaacggttccgaaggccggtaacgtaggttaacgtaacggtttccggaacggttaacgtacgtttacgtttaccttacgtccttaccgaactaccgtacgacgtaccgtcgtccacggtacgtccgtacgttacggttagttacgttacgtaaccgtttaactagttttacgtctaacgtactacgttactaacgtttccgttacctcgttacgttacgtacggacggtaacggacggtacgacgttaacgtacgttaacgacgttacgtcggtacgtacgtaccgtaccagttacg

SEQ ID NO: 101809 - DNA, 834 bp, Homo sapiens
  misc_feature: GYAE6OF02H4DUM.15.71.G05.1.454.CMB.1.raw
  modified_base (169)..(169): a, c, t, g, unknown or other
  misc_feature (169)..(169): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctggggctcctgctgctcgtgttcccaggttccagatgcgacatccagntgacgccagtctccatcttccgtgtctagctatcgtagtaggagacaggacgtccacaatctacgttcggtacgggacgtagtcgtaaggttagttacggctacgtcgttaggttacgaccgttaggtactacgacgaacgaacggaaaaacccgagggtaaaccccgtacccttaaagtcccgttacgtacggttacttacgttaacgtcgggttacacgtaacgttccggttaaggttaacggggtaaaccggttccggggtaacccctaaccgggtaaggttaccgaacggccgggttacctaaggtaacgtaacgttacgggtaacggaacgttcgttaacgtttaccgaccttacgtaccctacgtactacgtaacgtaccgtaccgtaccgtacacgtaaccggtccgttagggtaccgttagtttaccgtaaccttaaacggtttacttaaacgttacgtaaaccgtaacgtaccgtttaaacttaaacccgtttcgtttaccccgttacgtaaccgtttaaccggggacggttaaccccgggaggggtttaaaccgtaacgggtttaaaccgttaacggtaaacggttaaaacccggtaacgtttaaccggcgggttaaaccggtccttaaccgggtaaccctaacccgtttaacgg

SEQ ID NO: 101810 - DNA, 628 bp, Homo sapiens
  misc_feature: GYAE6OF02HZ88A.15.71.G05.1.454.CMB.1.raw
  modified_base (112)..(112): a, c, t, g, unknown or other
  misc_feature (112)..(112): n is a, c, g, or t
  modified_base (462)..(462): a, c, t, g, unknown or other
  misc_feature (462)..(462): n is a, c, g, or t
  modified_base (622)..(622): a, c, t, g, unknown or other
  misc_feature (622)..(622): n is a, c, g, or t
tcagtctacgtagccacgaccggtgctcgatttagtgtcgtcgcaagagagaggggtcaggctggaactgaggagcaggtgggggcacttctccctctaacactctccccgntcagctcctgggctcctgctgctctggttcccaggttccagatgcgtacatccagatgagccagtcctacatcttccgtgtctagcattcgagtaggagtacagacgttcacctatcgtcgttggtcggcaggtcagggtattgcagtcgtaggttacgccgtggtactcaggactaaacgaaccgaagggaaaccgtccctaacggctacctggaacttcgtaacgtgtcgtacctagtacccgtaggtttagggaaacggttcggggtaccccacgtaacggtcgaggtccggacgtaacgtgaaacgtgtaggaactagacttttcacgtctacacctatccatacncgtccgtgacgtcgcgtcgaggttacttttccgatttaaccgtaccgttaagttgtaaccgaacgtacgacgttaaccttccgttacccttcacgttccgttcggcggagtaccgaaggtccggataacgtaacgtaacgtactggacgtacttacgccncgttaa

SEQ ID NO: 101811 - DNA, 789 bp, Homo sapiens
  misc_feature: GYAE6OF02GV8IR.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctccgtggggctcctgctgctctggttcccaggttccagatgcgacactccgagatgacgccagtctccattccttccgtgtctgcatcgtagtaggagacgagacgtccaccactctacgttggccgggacgagttcgagggttattagcgagtcgtaggttacgtccgttagttactcgaagacgtaaacggaaaccgtaacgggaaaccgccccgtaacgtcctaccgtgtactcgtagtcggtacgctacgtccgttaagggtttacggtaaacgggttcccggggtaaccctaacggttaacggttaccggacggtaccggtacgtaaggtaacgtacgtcggtaacgggacgtacgttactttaccactttcccgtaaccgtaccacgttacgacgtcgaccgtaccgtacgacccgtcggtaccgttaagggttacggttttaattcccgtaaactttaacgttttacttacgttacctaaccggtaacgtaaccggttaaccgttaacccgttccgttttccccgtaccgttaacccggtttccgtttacgggggaacccgggtacgggtaaacccgggttaaggtacggtaaacccgttaacgttaaacccggtaacgttaccgggttcggtaacgtacccgtacgtacccgcgtttaaccgg

SEQ ID NO: 101812 - DNA, 693 bp, Homo sapiens
  misc_feature: GYAE6OF02HNG9B.15.71.G05.1.454.CMB.1.raw
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
tcagtctacgtagccacgaccggtgctcgatttagtgtcgtcgcaagagagaggggggtcaggctggaactgaggagcaggtgggggcacttctccctctaacactctccccgctcagctcctggggctcctgctgctctggttcccaggtccagatgcgacatccagtatgagccagtctccatccgttcgtgtctgctatctaggtaggagacagagtcacatctacgttcggtcgggcgtaggtacgtaggggtattggacngtcgttggttnccgtggtatcaggtacaacgaaaccgagggaaacccgaccccgtaatacccgtcctagacttcgtagtggtacgtactactaccgttagggtttaggaaacggttcgggacccgtaacgtaaggttccgaggtccgacgtaggtatacgtgtacggaactagttacttacgtctactaccgtacacgtccaaggcctacgcctggaaccgtcgtaccggttagttacggttagtttccgaagttttaacctaggtttactaggtaacaaccgtacggtaaccttaccgtttaacctttcccgtaccttacgttaacccgggttagggtaccgggtaaccgggtacggtaacggttagtaacgttaacgaaccggtaaaagtcggtacgttacggtactaccggtactaacccttcgg

SEQ ID NO: 101813 - DNA, 868 bp, Homo sapiens
  misc_feature: GYAE6OF02FPOI6.15.71.G05.1.454.CMB.1.raw
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
tcagtctacgtagccacgaccggtgctcgatttagtgtcgtcgcaagagagagggggtcaggctggaactgaggagcagggtgggggcacttctccctctaacactctccccgctcagctcctggggctcctgctgctctggttcccaggttccagatgcgacatccagntgagccagtctccatcttccgngttctgcatcgtagtagggacgacaggtagtccaaccactctacgttcggtcggggactagtccgaaggggttatttaggcaacgtcctaggggttacgccttggggtattacgacggcgaacggtaaaaacccgaaggggaaaacgaccccccggtaaacgtaccttaccccgtacgtaatccgttaagttggtacgtcgacttaccccgtaggttttagggaaaacgggtccgggggttacccctaaacccgtaaacggggttcctacggaccgggtcaaggtacgtaacttcgtacggggacgtaacggtactttaccgacttaccgtcctaaacccgtagtaccgtacgacacggtaaccctcggaccctacggaccggttacggtacggtttaacggttttttccggtaaacttaacccgttttaaaacttacgttaaccggttaccgtaaaacggtacggggttaacccttaaaccttttaacccgggttttaccccttacccgttacccgtttaacccgggttttacccggggtaaccggggtaccgggggttaaacccggttaacggggtaacgggtttaccgaaaacgggtttaaaccgtaaaaccgggtaaccgttgggttaaccgggtacccttttacgggaacccgtttaacccggtttaccgg

SEQ ID NO: 101814 - DNA, 859 bp, Homo sapiens
  misc_feature: GYAE6OF02JOUKW.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagtctccgtggggctcctgctgctcgtcggttcccaggttccagatcggcgacacgtccagatggacgcctagtccgtccattccgttccgtgcctagcattcgtaggtaaggacgtacaggtacacctaccatcctaacgttgggtaccgggcggtacggtacgtaaggggttaactaacggtaccgtaacgtaccgttaggggtttaccggtaccgttaagggttaacttcgaacggaaccgtaaacggaaaaaacccggggtaaacggggtaaacccggtacccccctttaaacggtccgttaccgtaagggaccttaacggtacggggttcgggtaacggtacctaaacgttaccggttaaacggggttttaacggggaaaacggggttcccgggggtaaaaccccctaggggttaaaccggtttaccggaaacgggtccgggacggtaaacgggttaatacgggtacccggtttaaacggggactaaacgggtttaccttacgtacccgttaccgtaccgtaacctacgtacgtaccgacggtaccgtacgtacgcgtacgtccggtacgtaggttacgttcgtaacgtaacctagttacgtagtaccgacgtacgtaaccgttacgtccttaccgttactccgttagtaccgggacggtaacggtacccggtaaggtacgttacgtaaccgtaacgtaacggttacgtacggttccgcgttacggtacctacgtaccg

SEQ ID NO: 101815 - DNA, 682 bp, Homo sapiens
  misc_feature: GYAE6OF02GL2L1.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctccgtggggctcctgctgctcgtcggttcccaggttccagatcgcgacactccgagatgacgccagtctccatctccgtgtctgctatcgtgaggagacgaggtacgtccacctatccgacgttcggtccgggacgtagtcgagggttatacgcgagtcgttggttacgcgtaggtactcgagacgaacggaaaccgaagggaaccgacccgtaagtcctaccgtagtacgtcgtagtggtcgactacgtcgtaggttacggaacggtccgggtacccacgtaaggtcgacggcggacgtagtacgtaacgtcggtacggaacgtacgttaccgtttacaccgttaccgtacctaccgtactacgacgtaccgacgtccgtagacccgtacgtcgtaggtacgttagtttacgacttaacgttacgtacgttacgtacgtaacgtacgtaaccgttaacgttccgtttaccctcgttacgttaccggttcgggacggtaacggtaccgtaggtaccgtataacgtaacgtaacgtcgtcggtacgtacgtacgtacctactacg

SEQ ID NO: 101816 - DNA, 862 bp, Homo sapiens
  misc_feature: GYAE6OF02I3KGM.15.71.G05.1.454.CMB.1.raw
  modified_base (784)..(784): a, c, t, g, unknown or other
  misc_feature (784)..(784): n is a, c, g, or t
tcagtctacgtagccacgaccggtgctcgatttagtgtcgtcgcaagagagagggggtcaggctggaactgaggagcaggtgggggcacttctccctctaacactctccccgctcagcctccgtgggctcctgctgctcgtcggttcccaggttccagagtcgcgacatccagactgacgccagtcctaccattcttccgtgtctagctatcgtaggtacggagacagtacgtaccacctatacgtacgttcggtaccgggcgtaggtacgtagggttattacgcgacgtcgttacggttacgccgttaggtactcgacgtacgaaaggtaaaccggacgggtaaaccgacccgtaagccgttacgtacgtacttacgtagtcgtacgactaccggttaacgttaggggtttacggaaacggttccggggtaacccaacggttacggttaccgacggtaccgggtactaacggtacgtaaaccgttcggtaaccggggtactaaacggtttcgtttacccgtacgttaccctaaccgtaacgtaccggtaccgaacggtaaccgtccgggtacctaccgggtaaccgtaacccgggttcggttaacgggtttaaacgtttaacgtttccgtaaaccgttttaaacctaacgtttccgggttaaccgttaaaaccgtaaccggtacggtttaaacccctttaacgtttccggttaccccgttaccttaaccgggttttaacgggacccggggtacggtaacccggttacggggtaaaccgggttntaaccgttaaacccggtacgttaaaacgggttccggttagggtaccgttaccgggaacttaccccttaccggttaacg

SEQ ID NO: 101817 - DNA, 718 bp, Homo sapiens
  misc_feature: GYAE6OF02FGIL3.15.71.G05.1.454.CMB.1.raw
  modified_base (335)..(335): a, c, t, g, unknown or other
  misc_feature (335)..(335): n is a, c, g, or t
tcagtctacgtagccacgaccggtgctcgatttagtgtcgtcgcaagagagagggggtcaggctggaactgaggagcaggtgggggcacttctccctctaacactctcccgctcagctcctgggctcctgctgctctggttcccaggttccagatgcgacatccagatgagccagtctccatccttcgtgtctgcatctgtaggagacagagtcaccatctacgttggtcgggcgtagtcgagggtattacgcagtcgtggttacgccgttggtactcgagacaacgaaacgacgggaaacgcccttaaagcctctagactacgtagtcgggtcnctaacttccgtaaggttttacggaaaacgggttccggggtaccctaacggtaaacgggttccgaagggtccggacgtaacgtaggaaacgttccggtaggggtaactacgggttaactttacccaaccgtttaccgtacccgaaacccttagtaacccgtaacggtaccgtaaacggtccccgttaacgggtacccaaaccgggttcccgttaagggaaccggttttagttttaccggaacttaaaccgttttacgttacgtttacaaacgtacgtaacggtacctttaaccttaccgttttccctacgttcgttaacgttccgggacgaacggtaccgtaaggtgactagtacgaaacgtcgtggtcgacgtctactctacg

SEQ ID NO: 101818 - DNA, 814 bp, Homo sapiens
  misc_feature: GYAE6OF02JDP8A.15.71.G05.1.454.CMB.1.raw
  modified_base (113)..(113): a, c, t, g, unknown or other
  misc_feature (113)..(113): n is a, c, g, or t
tcagtctacgtagccacgaccggtgctcgatttagtgtcgtcgcaagagagagggggtcaggctggaactgaggagcaggtgggggcacttctccctctaacactctccccgntcagctcctggggctcctgctgctcgtggttcccaggttccagtatgcgacactccagatgagccagtctccattccgttccgtgtcctgcatcgtagtaggacgagagtataccaccatcctacgttcggtccggggcgtaggtcgaagggttacttacggccgagtcgttagggttacgccgttaggtatccgagtacgaacgaaaccgaagggtaaaccgtaccccgtaacgtaccgtccgtacgtacgttactagtcgggtacgtacctacgttaccgtacgggtttaacgggttaaaccgggtccggggtaccccgtaaccgtaaacgggtttaccgaacggtaccgggacgtaacgggtacgtaaacgttccggtacgggaaccgtaacgttacgttttaccgtacccgtttacctacccgtaacctacgtacgacggtaccaacggtccgtacgacccgtacgtccggttaaggttacggtttacgtttaccgtaacgttaacctttaacgtttacgttacgttaaccgtaacgtaccgtaaccgttaaccctttacccgtttcccttaccgttaccgtttaccggttaccgggtaccgggtaaccgggaacgttaacgggtaacgtaacgttaaccgaaccggttaagtaccggttacggtaccgggtacgtcgtacccgtacgttaacccgg

SEQ ID NO: 101819 - DNA, 781 bp, Homo sapiens
  misc_feature: GYAE6OF02J3ENB.15.71.G05.1.454.CMB.1.raw
  modified_base (130)..(130): a, c, t, g, unknown or other
  misc_feature (130)..(130): n is a, c, g, or t
  modified_base (163)..(163): a, c, t, g, unknown or other
  misc_feature (163)..(163): n is a, c, g, or t
  modified_base (380)..(380): a, c, t, g, unknown or other
  misc_feature (380)..(380): n is a, c, g, or t
  modified_base (731)..(731): a, c, t, g, unknown or other
  misc_feature (731)..(731): n is a, c, g, or t
tcagtctacgtagccacgaccggtgctcgatttagtgtcgtcgcaagagagagggggtcaggctggaactgaggagcaggtgggggcacttctccctctaacactctccccgctcagctcctgggctccngctgctcgtcggtcccagttccagatcgcgacntccaggatcggacgtccagtcctccgacttcgttcgtcgtacctgctacgttcgtaggtaggacaccgaggtactaccaccattccgtacgttcggacgggtacgtacggtacgtaacgggttattacggaccgtaggttaccgttacgggttacgaccggttaggtaacgtccgaagtacccggaaacggtaaacccggaacggggttaaaccccncccccggttaagtacccgttaccgtacggtacttacgttacgggtcggtacctacggtaccgttaccgggttaagggtttaacggacccgggttacccggtaaccctcggggttaaacggtccgaaccgggttacgaacgttacgggtaacgacgttaccgggaacgtaccttacgttacttaccgaccacttacccgatccgttagacctaccggcgtacctagccgttacaggtacgtttacgttacttaccgacgttttacaccgttactttcgacctaaacgggtcccttaagttacccttcggtaccctaggtccgttacgggccggtacgaccggtagcggttanaactacgtaaccggtacgtcggtacgccgtattacccgaccgtgttaccg

SEQ ID NO: 101820 - DNA, 848 bp, Homo sapiens
  misc_feature: GYAE6OF02GMXWM.15.71.G05.1.454.CMB.1.raw
tcagtctacgtagccacgaccggtgctcgatttagtgtcgtcgcaagagagagggggtcaggctggaactgaggagcaggtgggggcacttcctcccctctaacacctctccccgctcacgctccctggggcctcctgctgctcgtcggttcccgaggttccagatcgcgacatccagatcggacgaccgtacgtcctcctacgttccgttccggttcgtactgcctattcgtaggtaacggagacgagacgtaccacctacgtccgtacgttcggtccgggacgtacggtacggtaagggttaagttacgacgtacggtcggtttacgggttacgtaccggttggttactaccgaacggtaaccgtaaaccggtaaaccggaaacgggaaacccgtaccccgtaacggtacccttaccgtagtaccttacgtaggttacggtacgtaccgtacttaccggttaagggtttaacggggtaaacggggttaccccggtaacccgtaaccgttaacggggttccgacgggtaccggtaggtaagtaacggtaacgtacgggtaacggacgttaacgtttaaccttcgtaccgtccgtaacccgtacgtacgacgtaacgcgtacgtccggaagcctaccgtcgttaacgttaggttaccgttacgtaaccgttactttaaccgttacgttacggtaaaccctagtaccgttaactttaccgtttaccgttcccttaccgttaaccggttcccggggttacggtaccgggaaaccgttaccggtaaggttaaccgtaactaaccgtaaccgtaaaccggtgtccggtacgtacgttccgaacttcccgtac

SEQ ID NO: 101821 - DNA, 888 bp, Homo sapiens
  misc_feature: GYAE6OF02I9RYW.15.71.G05.1.454.CMB.1.raw
tcagtctacgtagccacgaccggtgctcgatttagtgtcgtcgcaagagagagggggtcaggctggaactgaggagcaggtgggggcacttctccctctaacactctccccgctcagctcctggggctcctgctgctctcggttcccaggttccagatgcgacatccagatgacgccagtctccatctttccgtgtctgctatctagtaggagacagacgtccaaccagtcctacgttggtccggggacgtacggtacgtacggggttattacgcgtacggtcgttagggttacgccgttaggttagtaccgaaggacgaaacggtaaaaaccggaacggggaaaacccgtacccccggtaaacgtccgttaccgtaggtaactttaccgtaaggttcggtacgactacgttaccggttaagggtttaacggggtaaaacggttccggggtaaccctaaacggtacggttaccgacggtaccggacgtaaggttagtaacgtacggttaacgggaacgttagttaaccttttaccccgtaacccgtttaccgtaaccccgacccgttaacgaccgacggtaccctaaccggtccctacgggaaccgaacgggttacccgttagggttaacggtttaccgtttttacgtaacccgttaaaaccgttttacgtttaaacggtttacgttaaaccggaaaccgtacggtaaacccttttaacgggtacccgttttttacccgtacctttaccggttaaccgtttaccgggggaacgggtaaacccgggtaaccggttaaacgggttacggttaaacgttaaccctaaacggttaaacccggtacggttacgggttaccgtacccggtaacgttacccgtaccgtttaccgg

SEQ ID NO: 101822 - DNA, 253 bp, Homo sapiens
  misc_feature: GYAE6OF01E0XJS.1.78.H01.1.454.CMB.1.raw
  modified_base (253)..(253): a, c, t, g, unknown or other
  misc_feature (253)..(253): n is a, c, g, or t
tcagacgagtgcgtcacgaccggtgctcgatttagtgtgagtagtttgggtttgggacagacttcactctcaccatcagcagactggagcctgaagattttgcagtgtattactgtcagcagtatggtacctcaccgtacacttttggccaggggaccaagctggagatcaaacgaactgtggctgcaccatctgtcttcatcttcccgccatctgaacgcactcgtctgagcgggctggcaaggcgcatagn

SEQ ID NO: 101823 - DNA, 573 bp, Homo sapiens
  misc_feature: GYAE6OF01BM5BJ.1.78.H01.1.454.CMB.1.raw
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
tcagacgagtgcgtcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttcgaccacgtggggcccagggggacgcgtggtccaccgtctcctcacgccctccaccaagggcccatccggtccttccccctcggcccaccctccctccaacgacgccacctcgtcggggcacgacgccacgcccgtgggctcgccgtcggtcaacggacctaccttcccagttacctctactcgtgacggcgggctggacgaggcganatgnng

SEQ ID NO: 101824 - DNA, 312 bp, Homo sapiens
  misc_feature: GYAE6OF01BBTD5.1.78.H01.1.454.CMB.1.raw
  modified_base (262)..(262): a, c, t, g, unknown or other
  misc_feature (262)..(262): n is a, c, g, or t
  modified_base (279)..(280): a, c, t, g, unknown or other
  misc_feature (279)..(280): n is a, c, g, or t
  modified_base (282)..(312): a, c, t, g, unknown or other
  misc_feature (282)..(312): n is a, c, g, or t
tcagacgagtgcgtcacgaccggtgctcgatttagtgtgagtagtttgggttggcggacagatttcatgctaaaatcaggaggatggatgctgaggatgttgggctttattgctgccagcaaaagtacactattatcggaaaggggacccgtcttctacgttttcgggccggaagggtaccaaagggtggagatcaaaacgactgtggctgcaccatctgtcttcatccttcccgcatcgtgaacgcactcgtctgagcggntggccaaggcgcatagnnannnnnnnnnnnnnnnnnnnnnnnnnnnnnnn

SEQ ID NO: 101825 - DNA, 258 bp, Homo sapiens
  misc_feature: GYAE6OF01EU9WD.1.78.H01.1.454.CMB.1.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (254)..(258): a, c, t, g, unknown or other
  misc_feature (254)..(258): n is a, c, g, or t
tcagacgagtgcgtcacgaccggtgctcgatttagtgtgagtagtttgggtttgggacagacttcactctcaccatcagcagcctggagcctgaagtattttgcagtttattactgtcagcaccgtagcatctggcctctcgctttcggcggagggaccacggtggagatcaaaacgactgtggctgcaccatctgtcttcatccttcccgccctctcacgcactcgtctgngcgggctggcaaggcncatagnnnnn

SEQ ID NO: 101826 - DNA, 743 bp, Homo sapiens
  misc_feature: GYAE6OF01CLHWT.1.78.H01.1.454.CMB.1.raw
  modified_base (738)..(738): a, c, t, g, unknown or other
  misc_feature (738)..(738): n is a, c, g, or t
tcagacgagtgcgtcacgaccggtgctcgatttagtgtgagtagtttgggtttggggacgcctgggtacggccgggggggtcgctgagactctcctgtgcggcctctggatttaagttttaggagtcatgccatgaactggggtccgccaggctccgagggaaggggctggagtgggtctcggctattagtggcagtggtggcgctatatattatgcagaccgcccgtgaacgggccgttcacctatttccagagacaattcgaagaacacgctagtatctgacaagtggagacgcctagacgactcgacgacgaccggctctaatttattgtagtaaacggcgagtccgtagggaacgtaaccggggaccggggacccgtacgttcggaaccgtacggtcggggaccgaagggggaccgcgttcggacccaccgttcctccgtccgaaccgtcccctaccgaacccggacgggtacccctacggttcccggttcccccttacccccgtcggacccctcccctacccgtacccgaacggcgtaccccgtaccgttccgggtacgggggacccaaccggtacggcccgtaacgtccccgggtgggtccccgtccggttacccggttgggtaacccgtaaagggttccctttaacccgttacccgtagttacccgttacgttaaccgttcggtacgggacgggttcggacggttccggaacggtacggcgacggtaatgngtacg

SEQ ID NO: 101827 - DNA, 250 bp, Homo sapiens
  misc_feature: GYAE6OF02GKT73.1.78.H01.1.454.CMB.1.raw
  modified_base (249)..(250): a, c, t, g, unknown or other
  misc_feature (249)..(250): n is a, c, g, or t
tcagacgagtgcgtcacgaccggtgctcgatttagtgtgagtagtttgggtttgggacagacttcactctcaccatcagcagactggagcctgaagatttgcagtgtattactgtcagcagtatggtacctcaccgtacacttttggccaggggaccaagctggagatcaaacgactgtggctgcaccatctgtcttcatcttccgcatctgaacgcactcgtctgagcgggctggcaaggcgcatagnn

SEQ ID NO: 101828 - DNA, 273 bp, Homo sapiens
  misc_feature: GYAE6OF02FGRCP.1.78.H01.1.454.CMB.1.raw
  modified_base (258)..(273): a, c, t, g, unknown or other
  misc_feature (258)..(273): n is a, c, g, or t
tcagacgagtgcgtcacgaccggtgctcgatttagtgtgagtagtttgggtttgggacagatttcactctcaccatcagcagcgtgcaggctgaggatgtggcagtttattactgtcagcaattattatagtacagggttactacttttggccaggggacctaagctgcagatcaaacgaactgtggctgcaccagtctgtcttcatcttcccgccatctgaacgcactcgtctgagcgggctggcaaggcgcatagnnnnnnnnnnnnnnnn

SEQ ID NO: 101829 - DNA, 255 bp, Homo sapiens
  misc_feature: GYAE6OF02G9O40.1.78.H01.1.454.CMB.1.raw
  modified_base (253)..(255): a, c, t, g, unknown or other
  misc_feature (253)..(255): n is a, c, g, or t
tcagacgagtgcgtcacgaccggtgctcgatttagtgtgagtagtttgggtttgggacgagacttcactctcaccatcagcagactggagcctgaagattttgcagtgtattactgtcagcagtatggtacctcaccgtacacttttggccagggaccaagctgcagatcaaacgaactgtggctgcaccatctgtcttcatcttcccaccctcctcacgcactcgtctgagcgggctggcaaggcgcatagnnn

SEQ ID NO: 101830 - DNA, 257 bp, Homo sapiens
  misc_feature: GYAE6OF02GZYC9.1.78.H01.1.454.CMB.1.raw
  modified_base (255)..(257): a, c, t, g, unknown or other
  misc_feature (255)..(257): n is a, c, g, or t
tcagacgagtgcgtcacgaccggtgctcgatttagtgtgagtagtttgggtttgggtacagacttcacttctcaccatcagcagcctggagcctgaagattttgcgagtttattactgtcagcaccgtagcatctggcctctcgctttcggcggagggaccacggtggagatcaaacgaactgtggctgcaccatctgtcttcatcttcccgcatctgaacgcactcgtctgagcgggctggcaaggcgcatagnnn

SEQ ID NO: 101831 - DNA, 255 bp, Homo sapiens
  misc_feature: GYAE6OF02HUXQY.1.78.H01.1.454.CMB.1.raw
  modified_base (253)..(255): a, c, t, g, unknown or other
  misc_feature (253)..(255): n is a, c, g, or t
tcagacgagtgcgtcacgaccggtgctcgatttagtgtgagtagtttgggtttgggacagatttcactctcaccatcagcagcgtgcaggctgaggatgtggcagtttattactgtcagcaatattatagtacagggtacacttttggccaggggaccaagctgcagatcaaacgaactgtggctgcaccatctgtcttcatccttccaccctcctcacgcactcgtctgagcgggctggcaaggcgcatagnnn

SEQ ID NO: 101832 - DNA, 820 bp, Homo sapiens
  misc_feature: GYAE6OF02JKU8S.1.78.H01.1.454.CMB.1.raw
tcagacgagtgcgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagactttactgggcctttccgtacccgggctaacgttcccgggggtttaccccttaaacccggactttaccgtaacgtttcgggacctaacgggtccgggggttaccttagggggaaccccggttaactttttaccggaaccctttccgtttacccgaacccctaacgtttcccaaaggtcccaacggtcccccgttaggaccctaacggggtccctttaagggaaacgggtaaacgttcgggttacgggtacccgttaaaggtttttaactttaaccgtttcggtaccgtaaacggtaccttaaaaccgtaatttttaaacgttacccttttaccgtttttccggttaaccgttaacccgtttttccgggggacggttaacggggtaaacccgtaaggggttacgggtaagtaacggttaaccgaaaaaccgggttaaaccgttgggttaccggtaccgttacgggtacccgtaaccctacggtttaccgttacggttaccttttacccggaacc

SEQ ID NO: 101833 - DNA, 584 bp, Homo sapiens
  misc_feature: GYAE6OF02I26XQ.1.78.H01.1.454.CMB.1.raw
  modified_base (379)..(379): a, c, t, g, unknown or other
  misc_feature (379)..(379): n is a, c, g, or t
  modified_base (582)..(583): a, c, t, g, unknown or other
  misc_feature (582)..(583): n is a, c, g, or t
tcagacgagtgcgtcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacnctggtcaccgtctcctcacgcctcccaaccgaagggccccagtccggtccttccccccgtggcccaccctcctccaacgacgccacctcgtcggggccacgacgccacgcccgtgggcctcggcctcggtaccgaaaggaccttacgttaccacgtactctagtcctgacggccgggctcgggacgaacgggccgcgagtagnng

SEQ ID NO: 101834 - DNA, 291 bp, Homo sapiens
  misc_feature: GYAE6OF02ID51F.1.78.H01.1.454.CMB.1.raw
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
  modified_base (276)..(291): a, c, t, g, unknown or other
  misc_feature (276)..(291): n is a, c, g, or t
tcagacgagtgcgtcacgaccggtgctcgatttagtgtgagtagtttgggtttgggacaggacttcgactcctccaccgtactcgagtcagccttaggaggctgaagattttgcagtttattactgtacagcagcgtagcggtcgtggccgacactttcgggcccttgggaccaaggttgtacatcaagngaactggtggctgcacagtctgtcgttcattccttcccgnacttcggtgaacgcactcgtctgagcgggctggcaaggcncatagnnnnnnnnnnnnnnnn

SEQ ID NO: 101835 - DNA, 254 bp, Homo sapiens
  misc_feature: GYAE6OF02HG2XJ.1.78.H01.1.454.CMB.1.raw
  modified_base (253)..(254): a, c, t, g, unknown or other
  misc_feature (253)..(254): n is a, c, g, or t
tcagacgagtgcgtcacgaccggtgctcgatttagtgtgagtagtttgggtttgggacagacttcactctcaccatcagtagactggagcctgaagattttgcagtgtattactgtcaccagtatgcttcctcacccagaactttcggcggagggaccaaggtggagatcaaacgaactgtggctgcaccatctgtcttcatcttcccgccatctgaacgcactcgtctgagcgggctggcaaggcgcatagnn

SEQ ID NO: 101836 - DNA, 278 bp, Homo sapiens
  misc_feature: GYAE6OF02GOKJG.1.78.H01.1.454.CMB.1.raw
  modified_base (259)..(278): a, c, t, g, unknown or other
  misc_feature (259)..(278): n is a, c, g, or t
tcagacgagtgcgtcacgaccggtgctcgatttagtgtgagtagtttgggtttgggacagagttcactctcaccatcagcagcctgcagtctgaagattttgcaatttattactgtcaacagtattatagtacccctacgtggacgtttcggccaggggaccaagggtggaaagtcaaccgaatgtggctgcaccatctgtcttcatcttcccgcatctgaacgcactcgtctgagcgggctaggcaaggcgtcatagnnnnnnnnnnnnnnnnnnnn

SEQ ID NO: 101837 - DNA, 513 bp, Homo sapiens
  misc_feature: GYAE6OF01D6WM7.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattcctggggccagggaccctggtcaccgtctcctcagcctccaccaacgggcccatcggtcttcccctggcgccctgctccaggacgccacctccgagacgcacagccggccctgggctcgcctggtcaaggacctacttcccatactcgtctgagcggctggcaaggcgcag

SEQ ID NO: 101838 - DNA, 577 bp, Homo sapiens
  misc_feature: GYAE6OF01BQ93U.18.26.C04.1.454.CMB.1.raw
  modified_base (453)..(453): a, c, t, g, unknown or other
  misc_feature (453)..(453): n is a, c, g, or t
tcagtacgagtatgcacgaccggtgctcgatttagtctagcgactttgggtttgggtccctcccaagactctccctgtgcagcctcctcggattcaccttcagtaactactacatggcctggatccgccaggctccagggaagggctggagtacgtctcatacatcagtaacactggaaataccatataactacgcagactctgtgagggccgattcaccatcgccagggacaacgccaagacgctcacattatctgcagatgactgccctgagtagccgaggactcggccgtttactactgtgcgagagatcccggcgatgacgtcggcaccgggctcggtactaactttgattcccgtaggggccagggaaccctggtcaccgtctcctcagccctccaccaacgggccccagtccggtccttccccgtggccgtccctgcctccgaggcnccacctccgacgacgccacgacgcgggtcccttgggcctggcccgtggtccgaaacggtccgttaccttcccgacttacccgtcgtactcgacggcgggtacgtcggacacgggcgtccgtacg

SEQ ID NO: 101839 - DNA, 531 bp, Homo sapiens
  misc_feature: GYAE6OF01AYEJF.18.26.C04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttacactgtgcgagagatcccggngatgctggcaccggctggtactactttgattccgtggggccagggaaccctgggtccaccggtctcctcagccctccaccaacgggcccagtcggtcccttccccgtcggccgccctgcctccgaggacgccacctccgagacgcacacgccggccctgggctgcctggtcaacggctacttcccatactcgtctgacgcgggctcggacacggcgcgtag

SEQ ID NO: 101840 - DNA, 538 bp, Homo sapiens
  misc_feature: GYAE6OF01CIZQI.18.26.C04.1.454.CMB.1.raw
  modified_base (312)..(312): a, c, t, g, unknown or other
  misc_feature (312)..(312): n is a, c, g, or t
  modified_base (457)..(457): a, c, t, g, unknown or other
  misc_feature (457)..(457): n is a, c, g, or t
  modified_base (534)..(534): a, c, t, g, unknown or other
  misc_feature (534)..(534): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgattccgtggggccagggaaccctggtccaccgtctcctcagccctccaccagggcccacgtccggtcccttcccccgtggccgccccgtcgcctcccgaggacgccacctccgacgngccacgacgccgggccctgggctggccctggtccaaggcctacttcccatactcgtactgagcggctggacaaggcngtag

SEQ ID NO: 101841 - DNA, 584 bp, Homo sapiens
  misc_feature: GYAE6OF01C76F3.18.26.C04.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
tcagtacgagtatgcacgaccggtgctcgatttagtctagcgactttgggtttgggtcccgtcagactctcctgtgcagcctctggattcaccttcagtaactactacatggcctggatccgccaggctccagggaaggggctggagtacgtctcatacatcagtaacactaggaaataccatatactacgcagactctgtgaggggccattcaccatcgccagggacaacgccaagngctcacattanctgcagatgactgccctgagagccgaggactcggccgtttaacactgtgcgagagatcccggngatgctggcaccggctggtactactttgattccgtggggccagggaccctggtccaccgtctcctcacgcctccaaccaacggcccagtccggtccttccccgnggtccgccctgcctccgacggacgccacccgtcgacgacgccacgacggtccggtcccgtgggcctcgccgtaggtccgaaagggtccttaacccttcccgaagttaacccgttaccggtaacgtcggaacggtcccggggtctacgggccaaacgggccgacgaagg

SEQ ID NO: 101842 - DNA, 539 bp, Homo sapiens
  misc_feature: GYAE6OF01A9Y29.18.26.C04.1.454.CMB.1.raw
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgattccgnggggccagggaaccctgggtcaccgtctcctcacgcctccaccaacgggccccagtccggtccttcccccgtggccgcccctcgcctcccgaggacgccaccctcccgagacgccaccacgccggccctgggcctggcctggtcaaggcctacttcccattacncgtacngacgcgggctggcaaggcgcgag

SEQ ID NO: 101843 - DNA, 527 bp, Homo sapiens
  misc_feature: GYAE6OF01D82HL.18.26.C04.1.454.CMB.1.raw
  modified_base (312)..(312): a, c, t, g, unknown or other
  misc_feature (312)..(312): n is a, c, g, or t
  modified_base (415)..(415): a, c, t, g, unknown or other
  misc_feature (415)..(415): n is a, c, g, or t
  modified_base (523)..(523): a, c, t, g, unknown or other
  misc_feature (523)..(523): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgattccgtggggccagggaaccctggtcaccgtctcctcacgcctccaccaacgggcccatccggtccttcccccnggccgcccctcgcctccgaggcgccaccctccgagacgcacacgcggccctgggctgcctggcaagcctacttcccatactcgtctggagccgggctggacaaggcgntacg

SEQ ID NO: 101844 - DNA, 548 bp, Homo sapiens
  misc_feature: GYAE6OF01APM6O.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattccgtggggccagggaaccctggtcaccgtctcctcagcctccaccaacgggcccatccggtcttcccccgtggccgccctcgcctccgacggacgccaccctccgacgacgccacgacgccggccccgtgggcctcggcccgtggtccaacgggaccttaccgttccccatacctcgtactggacgcgggctggacacggcgcgag

SEQ ID NO: 101845 - DNA, 522 bp, Homo sapiens
  misc_feature: GYAE6OF01CT4M9.18.26.C04.1.454.CMB.1.raw
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (496)..(496): a, c, t, g, unknown or other
  misc_feature (496)..(496): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgagggccattcaccatcgccagggacaacgccaaagagctcacattatctgcagatgactgccctgagagccgaggactcggccgtttactactgtgcgagagatcccggnatgctggcaccggntggtactacttgattccgtggggccagggaccctggtcacgtctcncagccctcaccaaggcccatccggtccttccccgtggcccnccctgcctccacggacgccaccctcgagacgcaacgngccggcccngggctcgcctggcaacggcctactcccgatactcgtacngagcgggctcgggacaaggcgcgtag

SEQ ID NO: 101846 - DNA, 595 bp, Homo sapiens
  misc_feature: GYAE6OF01D6FBP.18.26.C04.1.454.CMB.1.raw
  modified_base (311)..(311): a, c, t, g, unknown or other
  misc_feature (311)..(311): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgacttccgtgggccagggaccctggtcaccgtctcctcagcctccaccaacggcccagtccggtccttcccccgcggccgcccgtgcctccgacggcgccaccgtccgacgacgcacgacgccggccccgtgggcctcggtcccgtcgggtaccgaaacggtacccttaccttccccgtaacgttaccgttccggttaccgtcggaacgggtccgggggtaccgttacggggaccgaaacggggtccgcgtaaacgg

SEQ ID NO: 101847 - DNA, 559 bp, Homo sapiens
  misc_feature: GYAE6OF01DVCBR.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaaacgccaaagagctcacattatctgcagatgactgccctgagagccgaggactcggccgtttactactgtgcgagagatcccggcgatgctggcaccgggctggtactactttgattctggggccagggaaccctggtcaccgtctcctcacgcctccacccaaagggcccaactcggtccttccccctcggcgccctcgctccacgacgacgaccaccaccgacgacgacacgacggcccgccgggcggtcgccgtcggtcgtacggaacgtaacgttaccctacctacctaccgtacgtacgtagcggcggcggcgacggacggcggac

SEQ ID NO: 101848 - DNA, 587 bp, Homo sapiens
  misc_feature: GYAE6OF01EKQ07.18.26.C04.1.454.CMB.1.raw
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggnatgctggcaccggctggtactactttgacttccgnggggccagggtaaccctggtccaccgtctcctcagccctccaccgacggcccagtccggtccttccccgtggccgtcccgtcgcctccgaggacgcctacccgtccgagacgcacgacggccggccccgtggggcctcggcccgtgggtaccgaacggtacccttaaccttccccgtaacttaccgtacggttactcggaacggtcccggggtactacgggaccgaacgggccgcgtaacgg

SEQ ID NO: 101849 - DNA, 629 bp, Homo sapiens
  misc_feature: GYAE6OF01C222O.18.26.C04.1.454.CMB.1.raw
  modified_base (462)..(462): a, c, t, g, unknown or other
  misc_feature (462)..(462): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcctgagagccgaggactcggccgtttactactgtgcgagagactcccggcgatcgctggcaccggctggtactactttgacttccgtggggccagggaccctgggtccaccggtctcctcacgtccctaccaaccgacgggcccctagttcccggtcccttcccccgtcgggtcccgccctcgcccttcccgacgggtacncccgtacccgtcgacgtacggcctaaccgcggcccgggtcccgtcgggcctcggtcccgtcggtaccgaacgggtacccttacccttacccggtaacttacccgtccggttaccgtcgggaccgggtccggggtccgttacgggaccgtaaacgggccgtagtaacg

SEQ ID NO: 101850 - DNA, 519 bp, Homo sapiens
  misc_feature: GYAE6OF01E1MFW.18.26.C04.1.454.CMB.1.raw
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcatgctggcaccggctggtactactttgattccgnggggccagggaaccctggtccaccgtctcctcacgcctccaccaacgggccagtccggtcttccccgngcgccctgctccgaggcgccaccgtccgagacgcacncgcggccctgggctgcctggtcaaggtacctacttccatactcgtacngagcggtctggacaggcgnag

SEQ ID NO: 101851 - DNA, 542 bp, Homo sapiens
  misc_feature: GYAE6OF01A6P3G.18.26.C04.1.454.CMB.1.raw
  modified_base (290)..(290): a, c, t, g, unknown or other
  misc_feature (290)..(290): n is a, c, g, or t
  modified_base (416)..(416): a, c, t, g, unknown or other
  misc_feature (416)..(416): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttanactgtgcgagagatcccggcgatgctggcaccggctggtactactttgattccgtggggccagggaacctggtcaccgtctcctcacgcctccacacgggccacgtcggtccttcccccgtggccnccccgtgcctccgacggacgccaccgtccgagacgccacacggccggccctgggctcggccctgggtcaaggcctacttcccatacctacggtcctggacggcgggctcggacgaacggcgctacg

SEQ ID NO: 101852 - DNA, 546 bp, Homo sapiens
  misc_feature: GYAE6OF01DKYLB.18.26.C04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtctagcgactttgggtttgggtccctcagactctcctatgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgagactcggccgtttactactgtgcgagagactccggnatgctggcaccggctggtactactttgacttccgtggggcccagggaaccctggtcaccgtctcctcgacgccctccaccgaacgggcccagtccggtcccttcccccgtggccgcccctgcctccgaggcgccaccctccgagcgcaccgagccggcccgtgggcctggccgtcggtcaacggctaccttcccacttactccgtacgtcgaggccgggtctcggcaacggcgcag

SEQ ID NO: 101853 - DNA, 555 bp, Homo sapiens
  misc_feature: GYAE6OF01DKFKJ.18.26.C04.1.454.CMB.1.raw
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctgggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatcgctggcaccggctggtacttacgtttgattccgtggggccagggaaccctggtcaccgtctcctcacgcctccaccacgggcccatccggtcttccccgnggccgccctcgcctcccgaggacnccacctccgacgacgccacacggccggccctggggcctcggcctggtaccgaaacggaccttaccttcccgaactacctcgtacctggacgcgggtctcggacaacgggcgctag

SEQ ID NO: 101854 - DNA, 574 bp, Homo sapiens
  misc_feature: GYAE6OF01CGZS1.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaagagctcacattatctgcagatgactgccctgagagccgaggactcggccgtttactactgtgcgagagatcccggcgatgctggcaccggctggtactactttgattcctggggccagggaaccctgggtccaccgtctccctcacgccctccaccaacgggccccatccggtccttcccccgtggcccgccctcgcctccgaggacgccgaccctccggaacgacgccaccgacggccggcccgtgggcctcggccctcgggtaccaacggaccttaaccgttcccaactaccttacggtactcgacggccggggtctcgggaccaagggccgcgtaag

SEQ ID NO: 101855 - DNA, 594 bp, Homo sapiens
  misc_feature: GYAE6OF01BUIAJ.18.26.C04.1.454.CMB.1.raw
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagagctcacattatctgcagatgactgccctgagagccgaggacctcggcctttactactgtgcgagagacgtcccggngatgctggccaccggntcggtacttacgtttgacttccgtggggacccacggggtaaccctgggtaccacccgttcctccctacgacgtcccctaccgaacccgaaccgggcccctacgttccgttccccttccccgtcggccctacccctcctaccaacgacgccacctcggtcgggccacgacggccggccgtgggcctcgccgtggtacaacggtaccttacccttcctacttaccgttcgtacgtcggacggcggcgtcggacgacggcgcagtgc

SEQ ID NO: 101856 - DNA, 600 bp, Homo sapiens
  misc_feature: GYAE6OF01C7BEX.18.26.C04.1.454.CMB.1.raw
  modified_base (328)..(328): a, c, t, g, unknown or other
  misc_feature (328)..(328): n is a, c, g, or t
  modified_base (487)..(487): a, c, t, g, unknown or other
  misc_feature (487)..(487): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaaagagctcacattatctgcagatgactgccctgagagccgaggactcggccgtttactactgtgcgagagactcccggcgatgctggcaccggntggtactactttgacttccgtggggccagggaaccctggtccaccgtctcctcacgcctaccaccgaacgggcccctagtcccggtaccttcccccgtcggcccgtccctcgcctccgacggcgccacccgtccgagacgccacgacggccggtcccgngggcctcgccgtgggtaccgaaacgggtaccttaccgttcccctaacgttaccgttaccggttacctacgggacggcccggggtcgttacgggaccgaacgggccgcgtaacg

SEQ ID NO: 101857 - DNA, 544 bp, Homo sapiens
  misc_feature: GYAE6OF01EULLJ.18.26.C04.1.454.CMB.1.raw
  modified_base (311)..(311): a, c, t, g, unknown or other
  misc_feature (311)..(311): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgattcctggggccagggaaccctggtccaccgtctcctcacgcctccaccaacgggcccatccggtccttcccccgtggccgcccctgcctcccaggacgccaccctccgagacgccacgacgccggccctgggcctcggccgtcggtcaacggtacctaccttcccacttacctcgtactcgagccgggtctggcaaggcgctag

SEQ ID NO: 101858 - DNA, 569 bp, Homo sapiens
  misc_feature: GYAE6OF01D04AK.18.26.C04.1.454.CMB.1.raw
  modified_base (249)..(249): a, c, t, g, unknown or other
  misc_feature (249)..(249): n is a, c, g, or t
  modified_base (562)..(562): a, c, t, g, unknown or other
  misc_feature (562)..(562): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagagctcacattanctgcagatgactgccctgagagccgaggactcggtccgtttactactgtgcgagagactcccggcgatgcgtggcaccggctggtactactttgacttccgtgggccacgggaccctggtccaccgtctcctcagtcttccaccaacgggcccatccggtccttccccgtcggccgccccgtgcctcccgacgggacgccacccgtcgtcgggggccacgacggcccggcccgtgggcgtcggccgtggtaccgaacggtacctaccttacccacgtaccgttcgtactggacggcgggcgtcggacagggcncgagtag

SEQ ID NO: 101859 - DNA, 609 bp, Homo sapiens
  misc_feature: GYAE6OF01B88VQ.18.26.C04.1.454.CMB.1.raw
  modified_base (312)..(312): a, c, t, g, unknown or other
  misc_feature (312)..(312): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccattcaccatcgccagggacaacgccaagagctcacattatctgcagatgactgccctgagagccgaggactcggccgtttactactgtgcgagagactcccggngatgctggccaccggtcgtggtactacgtttgacttccgtggggcccagggtaaccctggtccaccgtctccctcacgtccctcccaccgaacgggccctaacgtccggtcccttcccccgtcgggcccgtccctcgcctccgacggacgccaccgtccggacgcgccacgacggccggtcccgtcgggcctcggcccgtcggtaccgaaacggtacccttaccgttcccaacgttacccttaccggttacgtcggacgggtcccgggtcgtacgggaccgaacgggccgcgtaacg

SEQ ID NO: 101860 - DNA, 585 bp, Homo sapiens
  misc_feature: GYAE6OF01BQNGL.18.26.C04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttacactgtgcgagagatcccggngatgctggcaccggctggtactactttgattccgtggggccagggaaccctggtccaccgtctcctcacgccctccaccgaacgggcccagtccggtccttccccctgggccgccccgtgccttcccgacggacgccacccgtccgacgacgccacgacggccggcccgtgggcctcggtcccgtcgggtaccgaacgggtaccttaccgttccccgagttaccctacggttacgtcggacggccgggtctcgggaccgaacgggccgcgtaacg

SEQ ID NO: 101861 - DNA, 520 bp, Homo sapiens
  misc_feature: GYAE6OF01EHX7U.18.26.C04.1.454.CMB.1.raw
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattccgtggggccagggaaccctggtcaccggtctcctcagcctccaccacggccatcgtcttcccctggccaccctcctccacgacgcaccctctcggggcacgacgcggccctgggcctgcctggtcaaggactacttcccatacgtcgtactggacgcgggctggcaaggcgcngtgn

SEQ ID NO: 101862 - DNA, 745 bp, Homo sapiens
  misc_feature: GYAE6OF01CVSNK.18.26.C04.1.454.CMB.1.raw
  modified_base (236)..(236): a, c, t, g, unknown or other
  misc_feature (236)..(236): n is a, c, g, or t
  modified_base (523)..(523): a, c, t, g, unknown or other
  misc_feature (523)..(523): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcacatcgccagggacaacgccaagngctcacattatctgcagatgactgcctgacgacgccgaggactcggtccgtttacactgtgacgagagacgtcccggagatggctggcaccggtcgtacggttacttacgtttcggacgtttccggtcggggacccgtaaggggtaaccccttgggtaccctaacccggttctccccgtacgacggtcccctaccgaaccggtaacggcccctaggttccccgggttaccctttccccccgtcgggtaccccgtccccgtccgtcccgtacccggtaacgggtaccncccgtaacccgtccgggaaccgtacgacccgaaccggaccgggtcccgggtaccccggttacggggccgttacccggcccggttacggggtaacccgtaaaccgggtacccctttaaccgttaccccccgtaagtttaccccggttaccggttaaccgtaccgggtaaccggggtcccggggtccgtaacggggaccggaaccggggtcccgcgttaaacgg

SEQ ID NO: 101863 - DNA, 528 bp, Homo sapiens
  misc_feature: GYAE6OF01DJZNP.18.26.C04.1.454.CMB.1.raw
  modified_base (432)..(432): a, c, t, g, unknown or other
  misc_feature (432)..(432): n is a, c, g, or t
  modified_base (505)..(505): a, c, t, g, unknown or other
  misc_feature (505)..(505): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaagagctcacattatctgcagatgactgccctgagagccgaggactcggccgtttactactgtgcgagagatcccggcgatgctggcaccggctggtactactttgattccgtggggccagggaaccctggtcaccgtctcctcagcctccaccacgggcccatcggtccttccccgtggccgccctgctcccgaggacnccacctccgagacgcacgacggccggcccgtgggcctcgccgtggtccaaggcctactcccgatactcgtacngagcggctaggcaacggcgcgag

SEQ ID NO: 101864 - DNA, 633 bp, Homo sapiens
  misc_feature: GYAE6OF01BFSR3.18.26.C04.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtggaggggccgattcaccgatcgccagggacaacgccaagngctcacattanctgcaaatgactgccctgagagccgaggactcggccgtttacactggtgcgagacgactcccgggnatgctgggccgaccgggtcgtggtacttacgtttgacttccgtggggccaagggaccctggtccaccggtctcctcgacgtccctacccacccgaacggggcccctaagtcccggttccctttccccccgtcgggccccnccccgtcgcccttcccgacgggacgcccacccgtccggagacgaccaccgacggccggcccgtacgggccttcggcccgttgggtaaccaacggtacccttaaccttccccgaagttacccgttacggtacttcgggacgggcccgggtacgtcgggacgaacgggccgagcgtacg

SEQ ID NO: 101865 - DNA, 735 bp, Homo sapiens
  misc_feature: GYAE6OF01EIPET.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtggaggggccattcacctatccgccagggacaacgccaagagctcactattatctgcagatgactgccctagacgacgccgaggacgtccggtccgtttacacgttgtacgccggaagagaccgtccccgggagtacgtcggcgttcgggccgtacccgggtcttcggggttaactttaccgttttcggacgtttcccgggtacgggggccccgtaaacggggtaaccccgttggggtaccctacccggttccttcccgtaccgacggtaccccttacccgaacccggtaacgggcccctagttccccggttccccttcccccgcggtaccccgtccccgtcggccgtacccggacggaccgcccgtaccgtccggacgacgaccgaacgaccggcccgggtcccgtcgggtccgtcggtccggttacggtacgtaaccggtaccttaacccgttacccgtaacgttacccggtacccggttaacgtcgggacgggtccggggtccgtacgggaccgtaacggccgtacgtaacgg

SEQ ID NO: 101866 - DNA, 567 bp, Homo sapiens
  misc_feature: GYAE6OF01CAL6H.18.26.C04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagngatcccggcgatgctggcaccggctcggtactactttgattccgtggggccaggggaaccctgggtccaccgtctccgtcagcctcccaccaacgggcccagtccggtcccttccccgtggccgcccctgcctcccgaggacgccaccgtccgagacgccacgaggcccggtcccgtgggcctcggccgtggtccaacgggaccttaccgttccccattaccctacggttactggaggccgggctgggaccaacgggcgcgtacg

SEQ ID NO: 101867 - DNA, 678 bp, Homo sapiens
  misc_feature: GYAE6OF01DMXJR.18.26.C04.1.454.CMB.1.raw
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
tcagtacgagtatgcacgaccggtgctcgatttagtctagcgactttgggtttgggtccctcagactctcctgtgcagcctctggattcaccttcagtaactactacatggcctggatccaccaggctccgaggggaaggggctggagtacgtctcatacatcagtaacactaggaaataccatatactacgcagactctgtggagggccgattcaccatccgccagggacaacgccaagagctcacattatctgcagatgactgcctgagngccgaggctcggtcctttactacgtgtcgcgagacgacgtcccggngagtcgcgtcgggccgaccggtcgttcgggttaacttaccgtttgaccgtttccggtcgggggaccgtaacggggtaccccttgggtacctacccgttcgtccctacgacgccctccgaaccgaccgggtccctacgtcccggttccccgttccccgcggcccgtcccgtccgccctccgacggtcgacccgtaacccgtcggacgaccggccgtaaccggaccggtcccgggcccggtccgggtcctccgggcccgttacggtaccgaaccgggtaccttaccgtaccccgtacttaccgttacccgtaacggtcggaacggccggggtacgtacgggaccgaacgggccgtacgtaag

SEQ ID NO: 101868 - DNA, 673 bp, Homo sapiens
  misc_feature: GYAE6OF01BUK96.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactggaaataccatatactacgcagactctgtgagggccgattcacatcgcagggacaacgccaagagctcacattagtctgcagatgactgccctgagagccgaggctcggtacgtttacactgtcgcgtagacgtacgtcccggcgatcgcgtcggccgaccggtctacggtacttacgtttgaacgtttccggcggggtacccgaacgggtaacccgtggtaccgtaccgtcttcccgtcgacgtcccctaccgaaccggtaaacccgggtcccctaacggttcccggttccccgtttccccccgtcgggtaccccgtccccgttcgcccgttaccccgaacgggaccgacccgtacccgtacccggacgaccgccaacgtaccgggcccgtccggtcgggtctccgccgtacggtacgaacggtaccttacccgttccgaacttacgtccggttacgccgggacgggcccgtcgtacgggaacccgacgggtcctacgtaacg

SEQ ID NO: 101869 - DNA, 785 bp, Homo sapiens
  misc_feature: GYAE6OF01C64FF.18.26.C04.1.454.CMB.1.raw
  modified_base (246)..(246): a, c, t, g, unknown or other
  misc_feature (246)..(246): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaaggggctggagtacgtctcatacatcaagtaacactggaaataccatatactacgcagactcgtgtggacgggggccattcaccatccgccgagggacaacgccaaagngctcacattatctgcagatgactcgcctgagacgccgaggaccgtcggtacccgtttaactacgtcggtcggaccggaagtacggacgttcccccgggagaacgtttcggccttcggggaccgtaaccccgggtgtttacgggttaacctttaaccgtttttcggactttcccgggtacgggggaccccgttaaacggggggtaacccccttggggtaccctaccccgggtttcctccccgttacgacccggccccttaccccgaacccggaaaccgggtccccctaacggttccccgggttcccccgttccccccgggtcccgcccccgttgccccgttacccggaccgggaccgaccccgtacccgtacccgaacggaccggaccgaaccgacgggccccggtccccggtggggccttcggcccggtttacgggaaccgtaaccgggtaccttacccgttacccgtaacgttaccgtaccggtaaccggttggaccgggtcgggtccgtacgggccggaaacgggcgaagtcgtagg

SEQ ID NO: 101870 - DNA, 715 bp, Homo sapiens
  misc_feature: GYAE6OF01B4FMS.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaagagctcacattatctgcagatgactgccctgacgagccgaggacctcggccgtttactacgtgtgcgagagacgtccggcgatgctggcaccggctcggtacttacgtttgacttccgtggggaccgacgggtaaccctgggtaccaccggttctccctaccgacgtccctacccaacccggaacggggtccccaacgttccccgggttccccttcccccgtcgggccccgtccccttcggcccgttcccggaagggaccgcccgaacccgttcccgggaacggtacgccctaaccggaccgggtcccgggtaccccggttcggggtcctccgggtccccgttacggggtaacccgtaaacgggtaccctttaaccccgttaccccgtaacgttaaccccgttacgggttaacccgtcgggtaacccgggttccggggtaccggttcggggaccgtaaaccgggggtcccgaaggtaacgg

SEQ ID NO: 101871 - DNA, 697 bp, Homo sapiens
  misc_feature: GYAE6OF01C3ZWU.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctgggagtacgtctcatacatcagtaacactggaaataccatatactacgcagactctgtgaggggccgattcaccatcgccagggacaacgccaagagctacacattatctgcagatgactgccctgagagccgaggactcggtccgtttactactgtgcgagacgacgtcccggcgatcgcgtcggaccaccggctaggttacttacgtttgtaacgttcccgtcggggacctaacgggaaccccgttcggtaccctaccggttccttcccgtcaccgtccctaccgaacccgaacgggcccctaacgttcccgggttcccctttccccccgtgggtcccgtccccgtcgtcccgtcccgaacgggacgacccgtacccgtccggacgacgaccgaccggacggcccggggtcccgtcggggtcccgtcggtccgttaccgggtacgtaaaccgggtaccttaacccgttaccccgtaacgtttacccgtaccggtttaaccgcgggtaccgggccggggtaccgttagggaccgtaacgggccgtacgtaacgg

SEQ ID NO: 101872 - DNA, 744 bp, Homo sapiens
  misc_feature: GYAE6OF01EBYCE.18.26.C04.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (326)..(326): a, c, t, g, unknown or other
  misc_feature (326)..(326): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtggaggggccattcaccatcgcagggacaacgccaaagcgctcacatttacncgtncagatgactgccctgagacgccgaggaccgtccggtccgtttacacgtgtgacgagacgtacgtcccgggngtagtgcgtggccgacccgggtcgttaggttaccttagtttggacgttccggtcggggacccgtaacggggtacccctggtacctacccgtcctacccgtacgaccgtccccgtacccgaacccggaaccgggtcccgtaaccgttcccgggttccccgttaccccccgtcgggcccgtcccccgttcgtaccccgttacccgacgggacccgtacccgaaccccgtacccggacggtaaccgccgaacccgaccgggccccgggtaccccggtcggggtccgttcccgggttacccgtcggggttaaccgaaaccgggttaccccttaaccccgtttacccgtaacgtttacccgtaccggttaacggtcgggaaccggggtcgggtccgtacgggaaccgacgggtccgagtacgg

SEQ ID NO: 101873 - DNA, 622 bp, Homo sapiens
  misc_feature: GYAE6OF01BMFB2.18.26.C04.1.454.CMB.1.raw
  modified_base (316)..(316): a, c, t, g, unknown or other
  misc_feature (316)..(316): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaaagagctcacattatctgcagatgactgccctgagagccgaggactcggtccgtttactactgtgcgagacgactcccggngatgcgtggccgacggtcgtaggtacttacgtttgacgttccgtaggggccctaacgggaaccctggtacccgaccgttcctcctcgacgtccctaccgaacccgaacgggtcccctacgttcccgggttcccttcccccgtcgggtcccgtccccgtcgcccttccgacgaccgccacccgtaccgacgacgccgaccgcggccggcccgtcggcgtcggccgtggtacaacggtccctaaccgttcccacgttaccgtcggtaccgtcggacggcgggtcctacgggaccgaacggcgcgtacg

SEQ ID NO: 101874 - DNA, 608 bp, Homo sapiens
  misc_feature: GYAE6OF01BK2LW.18.26.C04.1.454.CMB.1.raw
  modified_base (464)..(464): a, c, t, g, unknown or other
  misc_feature (464)..(464): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
  modified_base (607)..(608): a, c, t, g, unknown or other
  misc_feature (607)..(608): n is a, c, g, or t
tcagtacgagtatgcacgaccggtgctcgatttagtctagcgactttgggtttgggtccctcagactctcctgtgcaggccctgcattcatctttaatagttattggatgcactgggtccgccaggcgtccgggggaaggggccggaggtgggtggccaacataatgcaagatggaactgagaagaactatgtggactctgtgaggccattcaccatctccagagacaacactaagaacttactgtatctgacaaaatgaacagcctcagagccgaggacacggctgtgtattacgtgtgacgaagagcgaggtggcgtgggactgtgggacgtcggtacggggaccgaacggggacccgtacggtaccacccggtcctcccgtcgacgtccctacccgaaccgacgggcccctacgttcccggtcccttcccccgtggcccgtcccgtgcctaccgaggtacnccgtaccgtccgagacgccgacgcggcccggtccgtcgggcctcgcccgttaggtaccgaacgtaccttacccttccacttaccgtcgtacgtcggcggcgggtcgtcgggacgaacgggtccgactaagtagcacgncgngnn

SEQ ID NO: 101875 - DNA, 631 bp, Homo sapiens
  misc_feature: GYAE6OF01BIDRA.18.26.C04.1.454.CMB.1.raw
  modified_base (375)..(375): a, c, t, g, unknown or other
  misc_feature (375)..(375): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtggaggggccgattccaccatcgccagggacaacgccaagagctcacattatctgcagatgactgccctagagacgccgaggacctcggtccgtttactacgtgtcgcgagagacgtcccgggcgatcgcgtgggccaccgggtcgttaggttacttacgtttcggacttccgggnggggcccgtaacgggtaaccctgggtaccacccgttctcccgtcacgtccctaccgacccgaccgggccctacgtcccggttacccgttccccgtcggtcccgtcccgtcgtccgtccgacggacgaccgacccgtaccgacgtacgccgacgaccgccggtccgcgggtcgtcgccgtcgtacgaacgtaccgttacctacccgacgttaccgtcgtacgtcggacggccggtcgcggacgacggcgacgtacgg

SEQ ID NO: 101876 - DNA, 860 bp, Homo sapiens
  misc_feature: GYAE6OF01EAQ2S.18.26.C04.1.454.CMB.1.raw
  modified_base (251)..(251): a, c, t, g, unknown or other
  misc_feature (251)..(251): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctggtgaggggccgattcaccatcgccgagggacaacgccaagagctcacattanctgcagatcgactgccctagacgacgccggaggactccggtacccgtttactaccgtggtcggcggagacggtacgtcccggcgtagtggtccgtcggaccgtacccgggtcgttacgggttaactttaccgtttcggtacctttcccgggtacgggggtaccccgtaaccggggtaacccccgttcggggtacccctaacccgggtttccctccccgttaccgtacccggtcccccgttaccccgaaaccccggtaacccggggtaccccccgtaaccgtttccccgggtttacccccccggtttccccccggtcccggggtcccccgggtccccccgttcccgggtaccccgttaccccgggaaccgggacccgtacccccgtaccccggttaccccgggaacggaaccggacccgaacccgggtaccgggccccgggtaccccggtcggggtcccgttcccggacccggtttcccgggtaacgggtaacccggttaaccctttacccgtttccccgtaaacgtttacccggttacccggtacccggttacgggtaccgggccggggtaccgtacggggtaacccgaacggggccgtaccggtaagg

SEQ ID NO: 101877 - DNA, 657 bp, Homo sapiens
  misc_feature: GYAE6OF01D1YXV.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggtcgattcaccatcgccagggacaacgccaagagctcacattatctgcagatgactgccctgagagccgaggactcggtccgtttactactgtgcgagagacgtccggcgatcgcgtggccgaccggtcgtcggtacttacgtttcggactttccggtcggggacccgaacggggtaaccctgggtacctacccggttcctcccgtcgaccgtccctcccgaaccgaaccgggcccctaacgttcccggttcccttcccccgtcggcccgtccccgtcgccctccgacggacgcccacccgtccgacgacgccaaccgacggcccgggtcccgtcgggtcctcggtccgtcgggtaccgaacggtacccttaccgttaccccaacgttacccgttaccgttacgtacgggacgggccgggtaccgtacgggaccgtaacgggccgacgtaacg

SEQ ID NO: 101878 - DNA, 730 bp, Homo sapiens
  misc_feature: GYAE6OF01BCMSQ.18.26.C04.1.454.CMB.1.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaaagagctcacattatctgcagatgactgccctgagngccggaggaccgtccggtaccgttttactaccgtgtggaccggagacggacgtccccgggngtatcggccgtcggccgacccgggtcgtgggttaccttacgtttgacgttccggtcgggggaccgacgggtaaccctcgggttccacccgttctccctcaccgtccctacccaaccgaccgggccctacgttcccgggttccccttcccccggttcgggccccgtcccgttacgtccccgtccggtaaccggccggtccctaacccgtcccgaaaggccgaacccgaccggaaccgggtccccgggtcccggtcggggccgttcgggtcccgtacgggtaaccgtacggggtaaacccctttaccgtttacccccgagtttacccgttacccgggttaaccgtcgggggtaacggcccggggttacggccgggtaaccggaacgggtccggaactaaggg

SEQ ID NO: 101879 - DNA, 532 bp, Homo sapiens
  misc_feature: GYAE6OF01BEAMC.18.26.C04.1.454.CMB.1.raw
  modified_base (256)..(256): a, c, t, g, unknown or other
  misc_feature (256)..(256): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattccaccatcgccagggacaacgccaagagctcacattatctgcagntgactgccctgagagccgaggactcggccgtttacaccgtgtcggcgagagactcccggngatgctggcaccggtctggtactacttgacttccgnggggccagggaccctggtccacgtctcctcacgcctccaccgacggcccatccgtcctccccgtgcctcctgcctcgaggcnccnccgcgacgngcacgcggcgtccgtggctgccgtggtacacggccttaccgtccactacgtacgtcncggacgcggtcgtggacacggtcncgtag

SEQ ID NO: 101880 - DNA, 771 bp, Homo sapiens
  misc_feature: GYAE6OF01BYYBY.18.26.C04.1.454.CMB.1.raw
  modified_base (239)..(239): a, c, t, g, unknown or other
  misc_feature (239)..(239): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaagggctggagtacgtctcatacatcaagtaacactggaaactaccatatactacgcagactctgtggaggggccattcacatcgcgagggacaacgacaagngctcacattatctgcagtatgactgccctgaacggacgaccggtaggaccgtcgggtacccgttttaactacgtgtcggacgaagacgtacgtcccgggacgtagtcggcgtcgggccgacccgggtacgttcggttaacttccgtttagtaccgttccggtacggggacccgtaaccggggttaacccctcgggttacctaaccccgttcctaccgtacccgacgtacccccgtaaccccgaacccgggtaaccggccccctaacggttccccggtttacccccgttcccccggtaccgggcccccgttaccccgaccggttccccgaaccggtacccggacggtaacccccgtaccccgtaccggaacggtaccggacccaaccggacccggtcccggggtccccgtaccgggctcccggtacggtaccgggtacgaaccggttacccgttacccgtacccgtagtacccgttcggtaccgtagggtaccggtaccgtacggtaccgtaacggccgggtaccagtaacgg

SEQ ID NO: 101881 - DNA, 722 bp, Homo sapiens
  misc_feature: GYAE6OF01DNQBS.18.26.C04.1.454.CMB.1.raw
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (713)..(713): a, c, t, g, unknown or other
  misc_feature (713)..(713): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaaggggctgggagtacgtctcatacatcagtaacactaggaaataccatatactacgcagactctgtggaggggccattcaccatcgcagggacacgccaagagctcacattatctgcagatgactcgcctggacgacggccgaggactcggtaccttttacacgtgtcgacgagacgacgtcccggngatcgcgtcggccaccgggtnttcggttaccttacgtttgacgtttccggcggggacccgtacgggtaacccttgggacccgttacccgttcctcccgttacgacgtcccctacccgaacccggaaccgggcccctacggttccccggttcccccttaccccggtcgggtcccctacccgtcgtacccgttcccgaacgggacctacccgtacccgtaccggaacggaccgccgtaaaccgggcggccccggggtacccggtcgggtacctcgggtccccgtaacgggtaacccgtaaaccggtacccgttaccccgttacccgtaaccgtttacccggtacggttacgtacggggacggtccggggcgttaccgggaacgaccgggtnacgtaacgg

SEQ ID NO: 101882 - DNA, 796 bp, Homo sapiens
  misc_feature: GYAE6OF01ECBVL.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagacgctcacattatctgcagatgactgcctgagagccgaggactcggtccgtttactactgtgcgagtagagtcccggcgagtgctggccgaccggcgtcggtacgtactttacgactttccgtcgggggcccaacggggaaccccttacgggtcgtaaccccgttccgtaccccttacacggtacccctacccgaaccccggtaaaccggggccccccgtaaacggttccccgggttacccgtttccccccccttacccggggtcccggcccccccgttcggggtccccctttaccccgaaccggggaaccggtaccccgaccccccgttacccgggtaacccggaacgggtcccaaacccgtaccggggaccccggggtcccccccgttcggggggtaccccgttccgggtacccccggttcgggtaccccggtaaacggggtaaccctaacccgtttttccccgaaaaccctttacgttacccggttacccgtaacgggttacccgggcgggggttaccccgtcgggggacccgaaacggggtcccgggctaaccggg

SEQ ID NO: 101883 - DNA, 768 bp, Homo sapiens
  misc_feature: GYAE6OF01CGPIN.18.26.C04.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (347)..(347): a, c, t, g, unknown or other
  misc_feature (347)..(347): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaagggctggagtacgtctcatacatcagtaacactggaaataccatatactacgcagactctgngagggccattcacatcgcaggacaacgcaagnctcacattatctgcagatcgactgccctgagagccgagacgtcggtccgtttacactggtcgacgaaggacgtacgtcccgggacgtatcggccgtcggaccggtaacccgggtnttacggggtttaaccttaaccgtttttggaaccgttttccccggtacggggggaccccgtaaaacggggggtaacccccgttggggtacccctaacccggtttcccttacccccgttacgaacccggtccccttaccccgaaaccccggtaaaccgggggcccccgtaacggtttccccgggttcccccttttcccccccggacggggtcccccgtcccccgttcgaccccgttaccgaaccgggtaccgaccgtaaccccgtaccggacgacgcccgtaaccgaccggcccggccccgttcggggacttcggcccgtagggtacccgaaggttacccttacccgttaccaccgttaccgttccggttaacgtgggaacgggcccgggtacgtacgggaccgtaacggccggtactaacgg

SEQ ID NO: 101884 - DNA, 847 bp, Homo sapiens
  misc_feature: GYAE6OF01A01BI.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaagagctcacattactctgcagatgactgccctgagacgccgaggactcggtccgtttactactgtgcgagacgacgtcccggcgagtgaccgtcggaccgtaccgggtcgtcgggttaaccttacgttttcgacgtttcccggtcgggggtaccccgaaccgggggtaaccccttggggtaccccgtaacccggtttcccgttaccccgttcccgtaaccggtaccccccgttacccccgaaccccggtaaaccgggggtcccccctaacgggttcccccgggtttacccccgtttcccccccggtcgggtcccccggttaccccccgtccgggtaccccttaccccggaaccggggtaaccgtacccccgtaaccccggttaccccgggaaccggtaccggtaacccaaccccggaccgggtcccccgggggtacccccgggttccgggggtcccgttaccgggcccgttaccgggtaaccgggtaaacccgggttaccccgtttaaccccgttaccccgtaaccgtttaacccgttcccggttaaccggttacgggtaaccggcccgggggtaccgttaccggggaccgaaccggggtcccgaacgtaacgg

SEQ ID NO: 101885 - DNA, 887 bp, Homo sapiens
  misc_feature: GYAE6OF01DCT7U.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccgagggggaaggggctgggagtacgtctcatacatcagtaacactaggaaactaccatatactacgcagtactcgtggtagggacggggccgtattccgacctacgtccggaccgacgggaacaaccgaccaaggacgcctacactactttatccgtagacgtagtactacggaccttccggcccgtaggacggaccggaccgggaacggtaccggttacccgggttacccggttttaacgttaccggttacggggtaccggacggaacggtaacggtacccggttccccgggacgttacgtcgggccggttaccgggtacccggtacccgggtacgtttaccgggtttaacctttaccgtttacggttacccggttccggggttaccggggaaccccggtaaccggggttaacccgttcgggtaccctaccccggtttccctacccgttacccgacccgtacccccgtaacccgaaccccgggaacccgggtccccttaccggtttcccccggttacccccgttccccccgggtcgggtacccccgtcccgtacccggtcccggtacccggaacggtcccgacccgtacccgacggacgaccggaccgaaccggtccgggacccggtcccggtacggtacccgtccggtaccgggtacggtaaccggtaacgtacccttacccgtaccgtaccgtaccgttcccggtacggacgggtcccgggacgggtccgtacgggaccgacggtcggctacggg

SEQ ID NO: 101886 - DNA, 787 bp, Homo sapiens
  misc_feature: GYAE6OF01DQG23.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccgaggggaaggggctggagtacgtctcatacatcagtaacactggaaataccatatactacgcagactctgtggaggggccgattcaccatcgccagggacaacgccaagagctcacattatctgcagatgactgccctgagagccgagactcggccgtttactacgtgtggcgagagacgtccggcgatgcgtggccgaccggctggtacttacgtttcgacgttccgtcggggcctacgggacccgtcggtcctaccggtcttccctcgacgtccctccgaacccgacgggacccctacgttcccggtacccgtttccccccgtcgggcccgtcccccgtcggtcccgtacccggtacgggaccgtcccgtaccccgtacccgggaacggaccgaaccgaacccggaaccgggtccccggggtcccccggttacgggggtcccgttacccggggttccccggttacccgggggtttaaacccgtaaaccggggttaaacccccgtttaaacccccgttttaacccccgtaaaccgttttaaacccccgttacccggtttaaacccgggtttacggggtaaacccgggggtcccgggggttaccgggttaacccggggtaccgggtaaaccgggggtaccccgtacggtaaaccggg

SEQ ID NO: 101887 - DNA, 644 bp, Homo sapiens
  misc_feature: GYAE6OF01CR32E.18.26.C04.1.454.CMB.1.raw
  modified_base (476)..(476): a, c, t, g, unknown or other
  misc_feature (476)..(476): n is a, c, g, or t
  modified_base (492)..(492): a, c, t, g, unknown or other
  misc_feature (492)..(492): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactaggaaataccatatactacgcagactctgtgaggggccattcaccatcgcagggacaacgccaagagctacacattatctagcagatcgactgccctgagagccggaggtactcggtacccgtttaactacgtgtcgcgagacgacgtccggctagtcggctggaccaccggtgtcggttaacttacgtttggtacctttccggtcggggacccgtaacggggtaaccctgggtccaaccggttcctccgacgacgtccctaccgaccgaacggccctagtcccgtcccttccccgcggcccgcncgccgtccgaggtccnctacccgtcgacgcggactaaccggcggtacccggccgtacgggtccgtacggtcccgtaggtacccgtaaacggtaccttacccgttcccgtaacgtaccgtacggttactacgggacggtccgggtacggtacggaggtacggctcgaag

SEQ ID NO: 101888 - DNA, 729 bp, Homo sapiens
  misc_feature: GYAE6OF01DK6YC.18.26.C04.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagngctcacattanctgcagatgactgccctgagngccgaggacctcggtccgtttactactgtgacgagagacgtcccggngatcgcgtcggccaccgggtctcggtacttactttggaacttcccggtgggggacccaacggggtaaccctgggtacccacccggttctcccgtcacggcccctacccgaacccgaacggggtccccctaacgttcccgggttaccccgtttccccccgtacgggtcccccgtccccgttcggcccttacccggaacgggaccggaccctaacccggtccgaacggaccgaccgaaccggacgggccccgggtaccccggtcgggggtaccttccgggacccgttcggggtaaccgtaaaccgggtacccttaaacccgtttaccccgtaaacgttacccgttaccggtttaaccgtacgggtacgggtacccggggtcgtaacggggaccgaaacggggtcgaccgtaagg

SEQ ID NO: 101889 - DNA, 689 bp, Homo sapiens
  misc_feature: GYAE6OF01A9GN8.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcacatcgccagggacaacgccaagagctcacattatctgcagatgactgccctgagcgccggaggactccggtccgtttactacgtggtgcgagacgacgtcccgggcgagtcgcgtggccgacccgggtctgggtacttacgtttgaacgttccggtaggggcccgagggtaaccccgtggtccaccgttcctcctccgacgtccctccgaaccgaaccgggcccacgttccggtcccttccccgtcgggccctcccgtcgcccgtacccgacggacgcccgtacccgccggaacggcgaccaccgacgggcccggggtcccggtaccgggtccgtaccgggtccccggttacggggtaaccgtaaccggggttaacccctttaccccgttaaccccgtaccgttacccgttacccgttaccggtacggacggggtccgggtaccgtacggggaccgtaacgggtccggcgtaacgg

SEQ ID NO: 101890 - DNA, 652 bp, Homo sapiens
  misc_feature: GYAE6OF01EB2EN.18.26.C04.1.454.CMB.1.raw
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagacgctcacattatctgcagatgactgccctgagagccgaggactccggtccgtttacacgtgtgcgagagactcccggnatcgctggccaccggtctggtacttacgtttgacgtttccgnggggacccaacggggtaccctggtaccacccgtctcctcacgtccctccgaaccgaaccgggccctacgttcccggttacccctttcccccggcggtcccgtccccgttcgtccctaccggacgggaccgccctacccgtccggagacgccaaccgacggcccgggtcccgttcggggacctccggtcccgtcgggtaaccgaacggtaccctacccgtaccctaacgttaccgttacggtaccgttgggaccgggtccggggtactcggggaacctaacgggccgtgtaacgg

SEQ ID NO: 101891 - DNA, 667 bp, Homo sapiens
  misc_feature: GYAE6OF01CUJPT.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactggaaataccatatactacgcagactctgtgaggggccgattcaccatcgccagggacaacgccaagagctcacattatctgcagatgactgccctgagacgcgaggactcggcgtttactacctgtgcgagagactcccggcgagtgccgtggccgaccggctcggttacttactttgacttccgtaggggcccacgggaaccctcgggtcacccggtcttcctcgacgtccctaccgaccgaacgggccccacgtccggtaccctttccccgacggtcccgccccgtcgccgtcccgagggtaccgcccgtaacccgtacccggacggacgtccgaaccgaccggcccgggtacccgtcgggtccctacgggcccgttacgggtaccgtaaaccgggtacccgttacccttacccccgtacgtaacccgttacccggttaccgacgggtacggaccgggtccggtacggacccggtaaacggggcccgtcggaaacg

SEQ ID NO: 101892 - DNA, 765 bp, Homo sapiens
  misc_feature: GYAE6OF01D6JS5.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactaggaaataccatatactacgcagactctggtgaggggccattccaccatcgccagggacaacgccaagacgctcacattatctgcagatgactcgccctaggacgacgccgaggaccgtccggttacccgtttaactacgtggttcggacggaaggacgaccgtcccgggagacgtcgcgtcggaccgaccgggtcttacggggttaacctttacgttttcggaacgtttcccgggtcgggggacccgtaaaccggggtaaccccgtttggggtaccccgtaacccggttcccttaccccgttaccgaaccggttccccgtacccgaaccccggaacccggggtacccctaccggttcccggttccccgttcccccgtcgggtcccgtccccctcggtcccgttacccggacgggaccgtcccgtacccgttaccggaacgacggacctaaccgggaccggcccgggtcccggtcggggaccttccgggtcccggtacgggtaccgaacgggttacccttaccgttacccgtacgttaccgttacggtaccgtcgggacggacccgggtcgtacgggaggtaacggccgtacgaag

SEQ ID NO: 101893 - DNA, 689 bp, Homo sapiens
  misc_feature: GYAE6OF01D11JM.18.26.C04.1.454.CMB.1.raw
  modified_base (361)..(361): a, c, t, g, unknown or other
  misc_feature (361)..(361): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (511)..(511): a, c, t, g, unknown or other
  misc_feature (511)..(511): n is a, c, g, or t
  modified_base (644)..(644): a, c, t, g, unknown or other
  misc_feature (644)..(644): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaagggctggagtacgtctcatacatcaagtaacactaggaaactaccatactacctacgcagactcgtggtggacggggcctacttccacctgtccgccgagggaaccaaccgaccaagacgcctacactattactctgctagtatcgtacctcgccgtaggacgcggaccggaggtaccgtccggttaccgttactacgtggtcgacggagcgtaccgcccggngagtcgcgtcggccgacggtgtacggttacttcgttcgacggttccggtcgggaccggaaccggtaccgtcgtaccctcccgtcctccncgtacccncccaaccgaccggaccgccctacggtcccttcccccgtccgaccgccgtcccncgtccgtaccggacgtccgaccccacggtaccgacgaccgccgacgcccgggcccgtcggttaccgtccggccgttcgggtaccggtaacgtacccgtacccttaccgtaccgtactacggtacggtaccggngggacccgggtcggtacggacccgtagggtaaccgcgacgtaacg

SEQ ID NO: 101894 - DNA, 922 bp, Homo sapiens
  misc_feature: GYAE6OF01C6T9E.18.26.C04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaagggctggagtacgtctcatacatcagtaacactaggaaataccatatactacgcagactctgtgaggggccattcacactcgccgagggacaacgccaagacgctacactattancgtgacaggatcgactcgccctaggaacgacggaccggaaggaccgttccggtttacccgtttaactaaccgtggtacggccggaaggacgaccggtcccggagtacgtcgcgtcggacccggtaaccggtcgttacggtttaccttacgtttcgtaccgtttccggggtcgggggtaacccgtaaccgggggtaccccgttacgggtccccgtaaccggttcccttcccccgtagaccccgtaccccgtaacccccgtaaccggtaaacccccggggtccccgtaaccggttttccccccggggtttaccccccgtttacccccccgggtccgggttacccccgtcccccgttacccggggtccccgttaccccgggtaaaccggggacccgtaccccccggtaaccccccgggttaccggaaccgggaacccgggacccggtaacccgggaccccggggcccgggggttaacccccggttcgggggtaccccgttcccggggtaccccgttacggggttaaccccgtaaacccgggttaccccctttaaccccgttaacccccgttaacgggtttaccccggttaaccggttaaccgggtccgggtaaccgggggcccggggtacgggttaccggaacccggggaaccgggtcgtaaccggtaaacgg

SEQ ID NO: 101895 - DNA, 735 bp, Homo sapiens
  misc_feature: GYAE6OF01CW0HW.18.26.C04.1.454.CMB.1.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaagggctggagtacgtctcatacatcaagtaacactggaaataccatatactacgcagactctgtggagggcatcaccatcgcagggacacgcaaganctcanagttacnctncgagatcgactgcctggacgacgaccggacggtctccgggtaccgtttacacgtgtagcgaagtacgacgtcccgggntaagngcgtcggctaccggtgtacggttaacttagtttacggtcgttcccggtagggggacccctaacggggtaacccgttggtaacccgtacccggttcttcccgtacggaccgtccccgtacccaacccgggaaccggtcccctaacggttcccggtttaccccgttccccggtacccggcccggtccccgtccgtacccgaccggtaacgggaccgtacccaaccccggttcgggaaaccgaccggaacccgacggacccgggtcccgggtcccgggtcgggtacccgtccgggtacccgtaccgggtaaccgaaccggttaaccccttaccgtaccccgtaagttacccgtccgttaacggacgggtaccgggcggtccggtaggtaccggacggtcgacgtaag

SEQ ID NO: 101896 - DNA, 732 bp, Homo sapiens
  misc_feature: GYAE6OF01ESYB4.18.26.C04.1.454.CMB.1.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctgggagtacgtctcatacatcagtaacactggaaataccatatactacgcagactctgtggagggccgtattcaccatcgccagggacaacgtccaaagcgctcactattanctgcagntggactgccctgagagccggaggcctcggccgtttacactgtgccgagngacgtcccggcgatgactcgggccaccgggtctaggttacttacgtttcgactttccgtcgggggccctaacggggtacccttgggtacccacccgttccgtcccttacgacgtccccttacccgaccccgtaacgggcccctaacgttcccgggttcccctttcccccccggtcggcccgtcccccgttacggtcccctcccggtacggacccggtccccgaccccgtttaccccgggaaggaacggacccgaaccgaacccgggccccgggggtaccccgtcgggggtcccgttccgggtccccgttaacgggtaccgtaaacgggtaccccttaacccggttcccctaacttacccgttcggtaacgttcgggacggtcgggggtaccgttacgggaccgaagggtccggtcctaaggg

SEQ ID NO: 101897 - DNA, 772 bp, Homo sapiens
  misc_feature: GYAE6OF01C32WU.18.26.C04.1.454.CMB.1.raw
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctgggagtacgtctcatacatcagtaacactaggaaataccatatactacgcagactctggtgaggggccatccacatccgacgagggacaacgccaagngctcacattatctagcagatggactcgaccctggagacgccggaggtaccgtccggtaccttttaacgactggtagcgaaggacgacgtcccgggngtatcggcgtcggaccgtaccggcgttacgggttactttacgtttgtaacggttcccggtacggggaacccgaccggggtaacccgtcggggttaccctacccgggttcctacccgtacgtacccgtccccgtaacccgtaaccccgggaacccgggtcccctaacgttcccccggggtttccccctttccccccggtacgggccccgtccccgtacgtcccgtaccgaacgggtacgaccccgtacccgtacccggaagaccggtaaccaccggtaccgggcccgggtaccccggtgggtcccgtacggtcccgggttaggtacccggtaaaccggttacccttacccgttaccccggaacttacccggttaccggttaccgtagggaccggggtaccgggtcgtaacggggacgaccgggcgtaaccgttagg

SEQ ID NO: 101898 - DNA, 906 bp, Homo sapiens
  misc_feature: GYAE6OF01CPELI.18.26.C04.1.454.CMB.1.raw
  modified_base (257)..(257): a, c, t, g, unknown or other
  misc_feature (257)..(257): n is a, c, g, or t
  modified_base (507)..(507): a, c, t, g, unknown or other
  misc_feature (507)..(507): n is a, c, g, or t
  modified_base (890)..(890): a, c, t, g, unknown or other
  misc_feature (890)..(890): n is a, c, g, or t
tcagtacgagtatgcacgaccggtgctcgatttagtctagcgactttgggtttgggtccctcagactctcctgtgcagcctctggattcaccttcagtaactactacatggcctggactcccgccaggcctcgaggggaagggctgggagtacgtctcatacatcagtaacactaggaaataccatataactacgcaagactctggtgaggggccaattcacatcgacaggacaacgcaagtgctacaacattatcngacagtatcgacgtcgccgtagaagacgaccggaggtacgtcggtacccttttaacgacttaggtgaccggtaagaacgtacccgttccggggactaacgtcggtaccgtcgggaacccgtaacggtcgttacggttaaccgtttacgttttacggtactttaccggggtcggggtaacccggaacccggggttaaaccccgttgggttacccctaaaccccgggttccgttacccctaccggtaacccnccccgttacccgaaacccgggaaccggggtacccccttaacggttccccggggttaacccccttttcccccggaccgggtccccgttccccgttacggacccgttaacccggaacgggaccctacccggtaaccccgtaaccgggagaacccgggtaacgaaccgggtaaccccggacccggggttccccggacggggtcccggtttcccgggtacccggttaccggggttaaaacccgaaaccggggtttaaaccccctttaacccgggtttaaccccctaaaaccgtttaccggtttaacccgggttaaaccgttaccgggggtaaaccgggggtaccccgggtaccggttaaacgggggaaccggaaaccccgggggttnaaacccgttaacgggg

SEQ ID NO: 101899 - DNA, 792 bp, Homo sapiens
  misc_feature: GYAE6OF01ENUZK.18.26.C04.1.454.CMB.1.raw
  modified_base (294)..(294): a, c, t, g, unknown or other
  misc_feature (294)..(294): n is a, c, g, or t
tcagtacgagtatgcacgaccggtgctcgatttagtctagcgactttgggtttgggtccctcagactctcctgtgcagcctctggattccaccttcagtaactactacatggcctggactccgccaggctccgagggaagggctggacgtacgtctcatacatcagtaacactaggaactaccatatactacgcagactctgtggaggggcctattaccgaccagtcgccgaggggacaaccgccaagacgctacactattagtcctgcaagctcgacgtcgccctaggaacgnggaccggtaggtaccgtccgggtttacccgttttaacgtccggttggtacggaccggtaaggtaacggtacccgttccccgggagttacgtcgggtaaccgttggacccctaccgggtccgtttaaggtaccttttaggtttcggtaaccgtttcccgggtacgggggtcccggtaaaccgggtccccgttaggggtccccctaacgttcccgtccgtacgacccgttaccccgtaccgaacccggtaacccggtccgtaccggtttcccggttcccccgttaccccggtcggtcccgtccccgtacgtcccgtaaccggacgaccgttaccccgacccgtaccggaacgtaccgtaccggaacctccgggcccgggtacccggtcggtccgtacggtacccgtacggtaaccggtaaccgtcccgttaccttaccgtaccgttacgttaccggtacgtcgggacgtccgggttacacgggacctaggcccgagtacg

SEQ ID NO: 101900 - DNA, 664 bp, Homo sapiens
  misc_feature: GYAE6OF01B27N5.18.26.C04.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccattcacatcgccagggacaacgccaagagctcacattatctgcagatgactcgcctgagagccgaggactcggtcctttactcgtgtgcgagagacgtcccggngatgcgtggcaccggtctcggtactacgtttgacgttccgnggggccaacgggtaccctggtccacccgtctccctcacgtccctaccgacccgaacgggccctacgttcccggttccccttccccggtcggcccgtccccgtcgtcctacccggaggaccgccgacccgttaccggacgacggaccaacccggaccgggccccgggtcccggttacgggtccgtccggtcccgttcggggtaaccgtaaacgggttacccttaacccgttaccccgtaacgttacccgttaccggttaaccgtgggaaccgggtccgggcgttacgggaccggaacgggccgtacgtacgg

SEQ ID NO: 101901 - DNA, 613 bp, Homo sapiens
  misc_feature: GYAE6OF01C5S82.18.26.C04.1.454.CMB.1.raw
  modified_base (155)..(155): a, c, t, g, unknown or other
  misc_feature (155)..(155): n is a, c, g, or t
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
tcagtacgagtatgcacgaccggtgctcgatttagtctagcgactttgggtttgggtccctcagactctcctgtgcagcctgtggattccaccttcaagtaactactacatcggcctggactccgcaggctcgaggggaggctggacgtacgtcncaatacatacgaagtaacactaggaaactacattanacgtacgacagtactgnggtaggaacgggcctnttccaacctagccgaccgaagggaacaaacgccgaaaagcgtcctacaatagtttacgcgtacgaatagaagttcgaacgtcgacgtagacgacgtacggacggtactccgggtacttttaacgagttggacgacgagaacgctccgggatagcgcgtcgaccgcgtagtcgtactttacgtgactcgggacggtcgaacggtccgtggtacctcccgtntaccgacgctacccgacgaccgacgtaccncgtacccgtctcccgtgcccncgtacncgacgacgcaccgtacgcganacgcncgacgcccgtgcggncgacgtcgacggtacnccgtctaacgtcgtacgtcgtagcgcgggacgtcgaacggccgaaagcctaagag

SEQ ID NO: 101902 - DNA, 755 bp, Homo sapiens
  misc_feature: GYAE6OF01B81UD.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccgagggagggctggagtacgtctcatacatcagtaacactaggaaataccatatactacgcagactctgtggagggccattcaccatccgaccaagggaacaacgaccgaagacgcctacaactaattctactgacagatgactcgactgagtacgccggaggtaccgtcggtaccctttatacgtgtcggacgagacgacggtcccgagtgtcgcggtgccgtaccggcgtttaggtaccttagtttcgaccgtttcggacgggggccgtaaccgggtacccgttcggtaccctacccgttcctacccgtacgaccgtccctaaccccgacggtaacccgggtccctaacggttcccggttacccccgttcccgacggtccccgtcccgtccgtacccttacccgggacgtacggaccccttaacccggcgtaacccggacgacccgaaccggtacccgggtaccccgggtcccgtacggggtccttacccgggaccggttacccgggtaacgtaaacccggttccctttacccgttaaccccgtacgttaaccccgggtcgttaaaccggcgggtaccggtccgggtaccggacggtaaaccggcggttaccgggaattaacgg

SEQ ID NO: 101903 - DNA, 707 bp, Homo sapiens
  misc_feature: GYAE6OF01CYHR2.18.26.C04.1.454.CMB.1.raw
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
tcagtacgagtatgcacgaccggtgctcgatttagtctagcgactttgggttttgggtccctcagactctcctgtgcagcctctggattcaccttcagtaactactacatggcctggatcccgccaggcctccgaggggaaggggctggagtacgtctcatacatcagtaacactggaaataccatatactacgcagactctgtggaggggccattcaccatccgaccgagggaacaacgccaaagagctcactattatctgcagatgactcgcctgagcgcgaggctcggtactttactctgngacgagagcgtcccggnagtcgcgtcggccgaccggtntacggtactttacgttgtaccgttccggtcggggaccgtaaccggggacccgttcggtaccctacccgttcctcccgtaccgccgtacccctaccgaacccgaccgggacccttaccgtcccgggttccccctttcccccggtaggtccccgtccccgttacgccccgtcccgaacgggtaccgaccctaccccgccgtaacgggacccgaccgtaccgaccgggtcccgggtcccgggtgggtcccgtcgggtcccggttagggttaacccgaaccgggttaccctttacccgtacccgtaacgttccttaaccgggtccgtcgggaccggaccgggtcgtagggaccggtacggcgagtacgg

SEQ ID NO: 101904 - DNA, 855 bp, Homo sapiens
  misc_feature: GYAE6OF01D8Z29.18.26.C04.1.454.CMB.1.raw
  modified_base (154)..(154): a, c, t, g, unknown or other
  misc_feature (154)..(154): n is a, c, g, or t
tcagtacgagtatgcacgaccggtgctcgatttagtctagcgacttttgggtttgggtccctcagactctcctgtgcagcctctggattcaccttcagtaactactacatggcctggatccgccaggctccagggaggggctggagtacgtctnatacatcaagtaacactaggaaataccatatactacgcagactctgtggacggggccgattccaccatccgaccagggaacaacgaccgaaagcgctccaactatttatctgacgagagtcgactccgccctagaggacgccggaagggaccttccgggttacccgtttaacgtaccgtggtggaccgtaggacggtaccgtaccccgggagtatcggccggttcggtaccccggaccgggtacgtttacgggttaacctttacgtttttacgggtaaccgtttcccggggttacgggggacccggaaaccgggggttaacccccgtttcggggtaccccgtaccccggtttccttaccccggttacaccccgggtacccccttaccccgaacccggtaacccgggtcccccgtaacgtttccccgggtttccccttccccccggtcgggtccccgtccccgttaccgtcccgttaccggaaccggtccgaccccgtaccccggtaccggaacggacgaccgtaccggaccgggtcccggtcccgggttacgggtcccgtccgggttaccggtacggtaaccgtaacgggttaccccttaaccgtttaaccccgtacgtttaacccgttcggttaaccgtacgggaccccggggtcggggtacccgttacgggggaaccgaacggggtccccgaggtaacg

SEQ ID NO: 101905 - DNA, 744 bp, Homo sapiens
  misc_feature: GYAE6OF01C2FKM.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccacggctccgagggaagggctggagtacgtctcatacatcagtaacactgaaataccatatactacgcagactctgtggaggggccattcacatcgcagggacaacgccaaagtacgctacacgattactcgtgcagatgactcgccctggagacgccgaggtacctccggtccgtttactacgtggtcgacggacgaagacggttcccgggcgtaagtcggcgttcgggccgtaacccgggcgtttacgggttaccttttaacgtttcggtaactttcccgggtacgggggtcccgtaaacggggaaccccttggggtcccgtacccgtccgttacccgttaccgccggtccccgtaacccgacccggtaaacccgggtccccgtaacggttcccgggttccccccgtttcccccggtcgggtccccgtccccgtccggtcccgttacccgacggggaccgtaccccgtacccgtacccggaacggacggacccaaccggtacccgggcccgggtcccggtcgggccgtcggtccgtacggtaccgtaacgtacccttaccttacccgtactccggtacgtacgtggaccggacgggtcgtaggacgtacggccgagtacg

SEQ ID NO: 101906 - DNA, 699 bp, Homo sapiens
  misc_feature: GYAE6OF01EV0NU.18.26.C04.1.454.CMB.1.raw
  modified_base (323)..(323): a, c, t, g, unknown or other
  misc_feature (323)..(323): n is a, c, g, or t
  modified_base (615)..(615): a, c, t, g, unknown or other
  misc_feature (615)..(615): n is a, c, g, or t
tcagtacgagtatgcacgaccggtgctcgattttagtctagcgacttttggggtttgggtcccgtcagactctcctgtgcagcctctggattcaccttcagtaactactacatggcctggactccgccaggctccgaggggaggggctgggagtacgtctcatacatcaagtaacacgtagaaactaccatatactacgcagactctggtaggaggggccattcaccatccgaccgagggaacaacgaccaagtacgctcaactattacgtctgacagatgactcgtcctaggagacgccggaggacctccggtaccgtttanacgttggcgacgagtagactcccggacattcgcgtaggcctaaccggtcgtaggttaacttcgttgaactttccggaggggaccaacgggtacctgggtaccctacccgtctccctacgacgtacccgtaccgaaccgtaaccggccctaggtttacccggttccccgttacccccggtcgggtacccctacccggttcgacccgttaccggaacggtacccggactaacccgtccggacgtacgcccaaccgtcggcccggtacccgtgggactcggtaccgttacggganaaccggttaccttaccgtaccctaagttaccgtccggtaacgtacgggacgtcgggtacgacgggaacgtacggcgaagttacg

SEQ ID NO: 101907 - DNA, 874 bp, Homo sapiens
  misc_feature: GYAE6OF01B1W17.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcaagtaacactggaaataccatatactacgcagactctgtgagggccgatcacatcgccagggacacgccaagagctacactattatctcgcaagatggactggccctgacggacgtaccgaggtaccgtcgggtaccgttttactacgttcgtcggccggtaaggacgacgttaccccgggacgaattcgggaccgtcgggacctacccggggtcgttacgggttaacctttacgtttttaggtaaccgtttccgggtacggggggtaccccgaaccgggggtaaaccccgttcggggttacccgtaacccggtttccttccccgttaccgaacccggttcccccgttaccccaaaccccggtaaccggggcccccttaaacggttccccggggtttaccccccttccccccgggttccgggtccccggtacccccgttcggtacccgtacccggaacgggtaaccgtaccccggaacccgtttccccgggaaacgtaccggacccgaaccggttacccgggccccggggtccccggttcggggtacccgttccgggtcccgggttaacgggttaccccggaaacgggttacccccgttaaacccgtttaccccgtaaaccgttacccgttttaaccgggtacccgttagggacccggggttccggggaacccggttcggggtaaacccgggacggaccccggttagtaacgg

SEQ ID NO: 101908 - DNA, 508 bp, Homo sapiens
  misc_feature: GYAE6OF02HXMWR.18.26.C04.1.454.CMB.1.raw
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (446)..(446): a, c, t, g, unknown or other
  misc_feature (446)..(446): n is a, c, g, or t
  modified_base (506)..(506): a, c, t, g, unknown or other
  misc_feature (506)..(506): n is a, c, g, or t
tcagtacgagtatgcacgaccggtgctcgatttagtctagcgactttgggtttgggtccctcagactctcctgtgcagcctctggattcaccttccagtaactactacatggccgtggatccgccaggctccaggggaagggctggagtacgtctcgatacatcagtaacactggaaataccatatactacgcagactctgtgaggggccgattcaccatcgccagggacaacgccaagagctcacattaanctagcagatgactgccctgagagccgaggactcggccgtttactactgtgcgagagatccggngatgcgtggcaccggctggtactacttgattccnggggccagggaaccctggtcaccgtctcctcagcctcaccaaggcccatcggtcttcccgtggccgccctgctccaggacgcacctccgagagcacngccgcctggctgctggtcaggactacgtccatacctcgtactgagcggctggcaaggcgnag

SEQ ID NO: 101909 - DNA, 521 bp, Homo sapiens
  misc_feature: GYAE6OF02G02PV.18.26.C04.1.454.CMB.1.raw
  modified_base (413)..(413): a, c, t, g, unknown or other
  misc_feature (413)..(413): n is a, c, g, or t
  modified_base (518)..(518): a, c, t, g, unknown or other
  misc_feature (518)..(518): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattcctggggccaggggaaccctgggtccaccgtctcctcagccctccaccaagggcccatccggtcttccccnggccgccctgcctccaggcgccaccctccgagacgcacgacgccggccctgggctcgcctggtcaaggtctacttccgatactcgtactgagcggctggcaggcncag

SEQ ID NO: 101910 - DNA, 501 bp, Homo sapiens
  misc_feature: GYAE6OF02IS23Z.18.26.C04.1.454.CMB.1.raw
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
  modified_base (499)..(499): a, c, t, g, unknown or other
  misc_feature (499)..(499): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcccctgagagccgaggactcggccgtttactactgtgcgagagatcccggngatgctggcaccggctggtactacttgattcctggggccagggaaccctggtcaccgtctcctcagcctccaccaaggccatcggtcttcccngcgccctgctccaggacgcacctcgagagcacagcggcctgggctgcctgtcaggctacttcccatacctcgtactgagcggctggcaaggcgnag

SEQ ID NO: 101911 - DNA, 512 bp, Homo sapiens
  misc_feature: GYAE6OF02GNHHZ.18.26.C04.1.454.CMB.1.raw
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
  modified_base (510)..(510): a, c, t, g, unknown or other
  misc_feature (510)..(510): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaccggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatccggcgatgctggcaccggctggtactactttgattcctggggccagggaaccctggtcaccgtntcctcagcctccaccagggcccatcggtcttccctgcgccctgctccaggacnccacctccgagacgcacagcggccctgggcctgcctggcaaggactacttcccgatactcgtactgacgcggctggcaacggcgnag

SEQ ID NO: 101912 - DNA, 525 bp, Homo sapiens
  misc_feature: GYAE6OF02I1I96.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttacactgtgcgagagatcccggcgatgctggcaccggctggtactacttgattcctggggccagggaccctggtcaccgtctcctcagcctccaccaacgggcccatccggtccttcccctggccgccctcgccttccgaggacgccaccctccgagacgcaccagccgcccgtgggcctgcccgtgggtccaaggctactcccattacctcgtactgagcgggctggcgaggcgcag

SEQ ID NO: 101913 - DNA, 608 bp, Homo sapiens
  misc_feature: GYAE6OF02HKPES.18.26.C04.1.454.CMB.1.raw
  modified_base (344)..(344): a, c, t, g, unknown or other
  misc_feature (344)..(344): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcacggctggtactacttgattcgnggggccacgggaaccctggtcaccgtctcctcacgcctaccaccgaacgggccccagtccggtccttccccgtggcccgtccctcgcctccgacggacgcccgtaccctccggacgacgaccaccgacgcccgggccccgtcggggcctccgggcccgtcgggtaccgaaacgggtcccttaacccgttccccgtaagttacccttccggttaaccttcggaacgggtccggggcgttcgggaccgaacgggccgacgtaacgg

SEQ ID NO: 101914 - DNA, 537 bp, Homo sapiens
  misc_feature: GYAE6OF02F44MA.18.26.C04.1.454.CMB.1.raw
  modified_base (535)..(535): a, c, t, g, unknown or other
  misc_feature (535)..(535): n is a, c, g, or t
tcagtacgagtatgcacgaccggtgctcgatttagtctagcgactttgggtttgggtccctcagactcttctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgttttacactgtgcgagagatcccggcgatgctggcaccggctggtactactttgattccgtggggccagggaaccctggtcaccgtctcctcagcctccaccacggcccatccggtccttccccgtggccgccccgtgccttccgacgggacgccacctccgagacgccacacgccggcccgtgggcctcgccgtggtcaacggtactacgttcccatacctccgtactgacggcgggctggacaggcgnag

SEQ ID NO: 101915 - DNA, 542 bp, Homo sapiens
  misc_feature: GYAE6OF02JII7B.18.26.C04.1.454.CMB.1.raw
  modified_base (311)..(311): a, c, t, g, unknown or other
  misc_feature (311)..(311): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactacttgattccgtggggccagggaaccctggtcaccgtctcctcagcctccaccgaagggcccatccggtccttcccctggccgccctgccttccgacggacgccacctccggacgacgccacgacgccggccctggggctcgccgtggtcaaggacctaccgtcccgaattaccgtcgtactgacgcgggctcggcaacggcgctaacg

SEQ ID NO: 101916 - DNA, 528 bp, Homo sapiens
  misc_feature: GYAE6OF02GZ6U5.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattccgtggggccagggaaccctggtcaccgtctcctcagcctccaccacgggccccatccggtccttcccccgtggccgcccctcgccttccgacgggacgccaccctccgagacgcacacgcggcctcgggctgcctggcaaggctactcccatacctcgtactgacgcggctggcaaggcgatacg

SEQ ID NO: 101917 - DNA, 488 bp, Homo sapiens
  misc_feature: GYAE6OF02FVNIN.18.26.C04.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (485)..(485): a, c, t, g, unknown or other
  misc_feature (485)..(485): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatccggcgatgctggcaccggctggtactactttgattcctggggccagggaaccctggtcaccgtctcctcagcctcaccaggcccatcggtctcccngcnccngctcngncnctcgngngcacngcgcctggctgcctgcaggctactccatactcgtactgacgcggctggcaaggcgnacg

SEQ ID NO: 101918 - DNA, 575 bp, Homo sapiens
  misc_feature: GYAE6OF02JA5CG.18.26.C04.1.454.CMB.1.raw
  modified_base (343)..(343): a, c, t, g, unknown or other
  misc_feature (343)..(343): n is a, c, g, or t
  modified_base (459)..(459): a, c, t, g, unknown or other
  misc_feature (459)..(459): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagactccggcatgctggcaccggctggtactacttgacttccnggggccagggaaccctggtcaccgtctcctcacgcctccaccgaacgggccccagtccggtccttccccgtggccgccctcgcctccgacggacgccacccgtccgacgcgccacncggccggcccgtgggccttcggcccgttggtccgaacggacctaccgttcccaacttacctcggttaaccgtggtaacggtccggggcttcgggaccgaacgggccgacgtaacgg

SEQ ID NO: 101919 - DNA, 541 bp, Homo sapiens
  misc_feature: GYAE6OF02G4576.18.26.C04.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
  modified_base (538)..(538): a, c, t, g, unknown or other
  misc_feature (538)..(538): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcccctgagagccgaggactcggccgtttactactgtgcgagagatcccggngatgctggcaccggntggtactactttgattccgnggggccaggggaaccctggtccaccgtctcctcacgcctccaccacgggccccagtccggtccttccccnggccgcccctgcctccgaggacnccacctccgagacgcacgagccggcccgtgggcctcggcctggtccaggacctacttcccgaattcctcgtactggacgcgggcctggccgaaggccngag

SEQ ID NO: 101920 - DNA, 542 bp, Homo sapiens
  misc_feature: GYAE6OF02HAAL8.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcccctgagagccgaggactcggccgtttacactgtgcgagagatcccggagatgctggcaccggctggtactacttgattccgtggggccagggaaccctggtcaccgtctcctcagcctccaccaagggcccatcggtccttccccgtggccgccctgccttccgacggacgccacccgtccgagacgccacacggccggcccgtgggcctggccctgggtccaacggacctaccttcccgatacctcgtacctgacggcgggctggccaaggcgctacg

SEQ ID NO: 101921 - DNA, 583 bp, Homo sapiens
  misc_feature: GYAE6OF02GE8XH.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgagggccgattcaccatcgccagggacaacgccaagagctcacattatctgcagatgactgccctgagagccgaggactcggccgtttacactgtgcgagagatcccggcgatgctggcaccggctggtactacttgattcctggggccagggaaccctggtcaccgtctcctcagcctccaccaagggccccatccggtcttcccccgtggcccgccctcgcctccacggacgccacccgtcccgagacgccacgagtcggcccgtggggccttcggcccgttggtccgaacgggaccttaaccgtttccccgaacttaccttacccggttaaccttacggacggtccggggtccgttcgggacgtaacgggccggactaacg

SEQ ID NO: 101922 - DNA, 542 bp, Homo sapiens
  misc_feature: GYAE6OF02H1JIJ.18.26.C04.1.454.CMB.1.raw
  modified_base (312)..(312): a, c, t, g, unknown or other
  misc_feature (312)..(312): n is a, c, g, or t
  modified_base (539)..(539): a, c, t, g, unknown or other
  misc_feature (539)..(539): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaaagagctcacattatctgcagatgactgccctgagagccgaggactcggccgtttactactgtgcgagagatcccggngatgctggcaccggctggtactacttgattccgtggggccagggaaccctggacaacgtctcctcacgcctccaccaacgggcccagtccggtccttccccgtggccgccctgcctccgacggacgccaccctccgacgacgcaaccgagccggcccgtggggctcggcctggtccaacggtaccttactcccatacctcgtactgagcgggcgtggcgaaggcganacg

SEQ ID NO: 101923 - DNA, 562 bp, Homo sapiens
  misc_feature: GYAE6OF02GYGKQ.18.26.C04.1.454.CMB.1.raw
  modified_base (413)..(413): a, c, t, g, unknown or other
  misc_feature (413)..(413): n is a, c, g, or t
  modified_base (556)..(556): a, c, t, g, unknown or other
  misc_feature (556)..(556): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccaggggacaacgccaagagctcacattatctgcagatgactgccctgagagccgaggactcggccgtttactactgtgcgagagactcccggcgatgctggcaccggctggtactacttgattccgtggggccagggaccctggtccaccgtctcctcacgcctccaccacggcccagtccggtccttccccnggccgtccctgcctccgacggacgccaccgtccgagacgcacgacgccggcccgtgggcctcgccgtagggccgaacggtaccttaccgttcccgaactaccgttccgtaacgtcggacggtcgggccgtggacgagggccgngtaacg

SEQ ID NO: 101924 - DNA, 555 bp, Homo sapiens
  misc_feature: GYAE6OF02IWQSF.18.26.C04.1.454.CMB.1.raw
  modified_base (378)..(378): a, c, t, g, unknown or other
  misc_feature (378)..(378): n is a, c, g, or t
  modified_base (551)..(551): a, c, t, g, unknown or other
  misc_feature (551)..(551): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgacttccgtggggccagggaaccctggtcacccgtctccncacgcctccgaccaacgggccccacgtccggtccttccccgtggccgccctcgccttccacggacgccgaccctccgagacgccacgacggccggcccgtcgggctcgccgtcggtcaacggacctaccttcccaactacctcgtactcggacgcgggcgtcggcacgggcgntacg

SEQ ID NO: 101925 - DNA, 525 bp, Homo sapiens
  misc_feature: GYAE6OF02G4VBD.18.26.C04.1.454.CMB.1.raw
  modified_base (311)..(311): a, c, t, g, unknown or other
  misc_feature (311)..(311): n is a, c, g, or t
  modified_base (449)..(449): a, c, t, g, unknown or other
  misc_feature (449)..(449): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactacttgattccgtggggccaggggaaccctggtcaccgtctcctcagcctccaccaagggcccatcggtccttcccctggccgccctcgcctccaggacgccacctccgagcgcacncgcggccctgggctcggcctggtcaggactacttcccatacctcgtactgagcgggctcggcgaaggtccgatacg

SEQ ID NO: 101926 - DNA, 567 bp, Homo sapiens
  misc_feature: GYAE6OF02GXTH2.18.26.C04.1.454.CMB.1.raw
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactggaaataccatatactacgcagactctgtgagggccgattcaccatcgcagggacaacgccaagagctcacattatctgcagatgactgccctgagagccgaggactcggccgtttacacgtgtgcgagagactcccggcgatgcgtggcaccggctcggtaacttactttgattcccgtggggcccagggaacccgtggtccaccgtcctccctcacgccctccgaaccgtacgggcccagttccggtcccttccccgnggccgtcccctgtcctccgacgggcnccgacccgtccggacgagccacgacggcccgccgtgggctcgccgtggacacggacttccctaccgtacttacctcgtacgcggtcgcgggctggacgacgggtccgatacg

SEQ ID NO: 101927 - DNA, 541 bp, Homo sapiens
  misc_feature: GYAE6OF02H94WB.18.26.C04.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaactccaagagctcacattatctgcagatgactgccctgagagccgaggactcggccgttactactgtgcgagagatcccggngatgctggcaccggntggtactacttgattccgtggggccagggaccctggtcaccgtctccncagcctccaccacggcccatccggtcttcccctggccgccctgcctccgacggacgccaccgtccgagacgccacgacgccgggcccgtgggcctcggccctgggtaccaaggaccttaccttcccgattacctcgttacgtgaggcgggctcggcgaacggcgctag

SEQ ID NO: 101928 - DNA, 612 bp, Homo sapiens
  misc_feature: GYAE6OF02IW4DW.18.26.C04.1.454.CMB.1.raw
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
tcagtacgagtatgcacgaccggtgctcgatttagtctagcgacttttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaaagagctcacattanctgcagatgactgccctgagagccgaggacctcggccgtttacactgtgcgagagatcccggngatcgctggcaccggctggtactacttgacttcctggggccagggaaccctggccaccgtctcctcagcctaccaccaaggcccatccggtcttccccgtggccgtccctcgcctccgaggtacgcctaccccgtccgaacggtacgaccacgacggccggacccgtcgggccttcgcccgttgggtaccaacgggtaccttaaccgtttaccccaagtttaacccgaccgttaaccggttacggaacggtcccggggaccgttacggggacccgtaaacgggggccctaaccgtaacgg

SEQ ID NO: 101929 - DNA, 565 bp, Homo sapiens
  misc_feature: GYAE6OF02FLAGG.18.26.C04.1.454.CMB.1.raw
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgccagggacaacgccaagagctcacattatctgcagatgactgccctgagagccgaggactcggccgtttacactgtgcgagagatcccggcgatgctggcaccggntggtactacttgattccgtggggccagggaccctggtcaccgtcncctcacgcctccaccaggcccatccggtccttcccctggccgccctcgcctccgaggacgccaccctccgagacgccacgacgccggcccgtgggcctcggccgtcgggtaccaagggaccttaccgttccccaacttaccgtaccgttaacctcgacggtcccggggactcgggaccgaacgggccgaccgtaag

SEQ ID NO: 101930 - DNA, 784 bp, Homo sapiens
  misc_feature: GYAE6OF02J3W7Z.18.26.C04.1.454.CMB.1.raw
  modified_base (277)..(277): a, c, t, g, unknown or other
  misc_feature (277)..(277): n is a, c, g, or t
  modified_base (592)..(592): a, c, t, g, unknown or other
  misc_feature (592)..(592): n is a, c, g, or t
  modified_base (707)..(707): a, c, t, g, unknown or other
  misc_feature (707)..(707): n is a, c, g, or t
  modified_base (783)..(783): a, c, t, g, unknown or other
  misc_feature (783)..(783): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgagggaagggctggactacgtctacatacatcacgtaacacgtagaaactaccatactactacgcaagtctcgtgtacggacgggcctattccaccacgtccggaccgagggaaccaaccgcaaacgtcgctaccattacgttctcncggactagactcgtaccgcgtccgacggacgccggtaaccggtacggtaccggttaccggtttacccgttaagtccggtaggtaccgtaaccggacgtaccggcccggtccggactacgtcggtccggcccgtaccggtaccgttcggttaccgttacgttacgtcggttacccggtccgggtaccgggtaccggtaaccgtccgtccgttaaccccgtccttcccgaccgtacccgccgttaccccgtacccggaacccggtcccgtacctaccccggtttccccggttacccgccgttccccggccgttaccnccggtaaccgcgtaaccggacccgtacccgttaccggacaccggtacccgacggacccggacccggtcgacccggtcgtaccgccgttacggtaaccgtacgtaccgtttacccncgtaccgttacggaccttcggttaaccgggccgggtaaggtcccggtaacggtaaccggaccgtcggtactacggng

SEQ ID NO: 101931 - DNA, 585 bp, Homo sapiens
  misc_feature: GYAE6OF02FHP9I.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactacttgattccgtggggccagggaccctggtccaccgtctcctcagccctccaccgaacgggcccagtccggtccttcccccgtggccgccctcgcctccgacggacgccacctccgagacgccacgacgccggcccgtcgggcctcggcccgtcggtaccgaacggtacctaaccgttcccgtaattacccgtaccggttacctcggtacggtccggggtccgttacgggaccgaacgggcgtaccgtaacg

SEQ ID NO: 101932 - DNA, 576 bp, Homo sapiens
  misc_feature: GYAE6OF02G1XHM.18.26.C04.1.454.CMB.1.raw
tcagtacgagtatgcacgaccggtgctcgatttagtctagcgactttgggtttgggtccctcagactctcctgtgcagcctctggattcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttagtcgcgaaacggggggggtactacgtacgctatggacgtcgtggggccaagggaccacggtcaccgtctcctcacgcctccaccaacggcccatcggtccttcccctcggccacccctcctccaagacgccacctcgtggggccacgcgccggccctgggcctcggcctcgggtacaacggacctaccgttacccataccgtcgtacctggacggcggcgtcggcaaggccgacgagtagcg

SEQ ID NO: 101933 - DNA, 592 bp, Homo sapiens
  misc_feature: GYAE6OF02IG2TX.18.26.C04.1.454.CMB.1.raw
  modified_base (311)..(311): a, c, t, g, unknown or other
  misc_feature (311)..(311): n is a, c, g, or t
  modified_base (587)..(587): a, c, t, g, unknown or other
  misc_feature (587)..(587): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcctgagagccgagactcggtccttactacgtgtgacgagagactcccggnatgcgtggccaccggctggtactactttgagttccgtggggacccacgggaacccttgggcctaccggtctcctcgactccctaccgaccgaacggtccccagtcccggttcccttccccgtcggcccgtccctcgccctcgaacggcgccctacccgtccggaacgcgactaccgacgccgggcccgtgggcctacgccgtggaccgtagtaccttacccgtcccgattacccgtcgtacgttaggacgtcgggacctgggaccgaacggtccgntaacg

SEQ ID NO: 101934 - DNA, 573 bp, Homo sapiens
  misc_feature: GYAE6OF02GO1BF.18.26.C04.1.454.CMB.1.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (443)..(443): a, c, t, g, unknown or other
  misc_feature (443)..(443): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatcgcagggacaacgccaagagctcacattatctgcagatgactgcctgagngccgaggactcggccgtttacactgtgcgagagactccccggngatgctggccaccggctggtactacttgacttccgtggggccacgggaaccctggtaccaccgtctccgtcacgccctaccaccgacggcccagtccggtcccttccccgtggcccgccctcgcctccgaggcnccaccgtccgagcgccacgacggccggcccgtgggtcctcggccgtggtaccaacggtccttacctcccaattacccttcgtaacgttcggacggtccgggtcgtacgggaccgaacggtccgataacgg

SEQ ID NO: 101935 - DNA, 753 bp, Homo sapiens
  misc_feature: GYAE6OF02IFGAR.18.26.C04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtctagcgactttgggtttgggtccctcagacctctccttgtgccagcctctggattcaccttcagtaactactacatggcctggatccgccaggctccagggaagggctggagtacgtctcatacatcagtaaacactggaaataccatatactacgcagactctgtgagggccattcaccagtcgcaggacacgccaagngctcacattatctgcagatgactgccctgagagccgaggacctcggaccgtttacactggtcgcgagacgactcccggagtatcgcgttagggacctaaccgggtcttacgggttaaccttaccgttttgaacgtttacccggtagggggaacccctaacgggggtaaacccccttggggtaccctaaccccgggtttcctacccgtacgacgtaccccttacccgaacccgtaacggggcccctaagttcccggttcctttacccccgtcgggtaccctccccgtagtacccgttacccggaacgggaccgacccgtaaccccgtaccggaacgtacggacccgaaccgaccggtacccgggcccgttaggggtcccgtacgggtcccgttacgggtaacccgtaaccgggtaccctttaacccgtttccccgaaagttacccgttccggttaaccgttacggaccggtccgggtccggttaccgggacccggtaaacgggcccgtaacgtaacgg

SEQ ID NO: 101936 - DNA, 699 bp, Homo sapiens
  misc_feature: GYAE6OF02FJE24.18.26.C04.1.454.CMB.1.raw
  modified_base (308)..(308): a, c, t, g, unknown or other
  misc_feature (308)..(308): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatccgccagggacaacgccaagagctcacattatctgcagatgactgcctgagagccgagctcggcctttacactgtgcgagagacgtcccggngatggctggccaccggcgttaggtacttacgtttgactttccggtacggggaccctaacggggtaacccctgggtacctacccgttctacccgttcgaacgtcccgtaccgaaccgaacgggtcccctaacgttcccggttcccttcccccgtggcccgtcccgtacgtccttaccgacggaccgaccgtacccgtaccgaacggaacgaccgtaaccgaccgggtaccccgggtccccggtcgggggtacccttccgggtacccggttcgggtaacccgtaaaccggttacccgttaacccgtttaccccgtaaacttacccggttaccgttacggttacggaccgggttccgggcgttacgggaccggtaacgggccgtacggtaacgg

SEQ ID NO: 101937 - DNA, 542 bp, Homo sapiens
  misc_feature: GYAE6OF02H8A5D.18.26.C04.1.454.CMB.1.raw
  modified_base (94)..(94): a, c, t, g, unknown or other
  misc_feature (94)..(94): n is a, c, g, or t
  modified_base (190)..(190): a, c, t, g, unknown or other
  misc_feature (190)..(190): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (501)..(501): a, c, t, g, unknown or other
  misc_feature (501)..(501): n is a, c, g, or t
tcagtacgagtatgcacgaccggtgctcgatttagtctagcgactttgggtttgggtccctcagactctctgtgcagcctctggattcaccttnagtaactactacatggcctggatccgccagctccaggagggctggatacgctcatacatcagtacactggaatccatatactacgcagactctgtnaggggccattcaccatcgccagggacaacgtccaagngctacacagttanctagcagatgactgccctgaganccgaggactcggccgttttacatcgngcggagagatccccggngatggctggcaccggtctggtactacttgattcctgggccagggacctggtcacgtcncctcagcctcactaaggccatccggtcttcccgngccgccctaggcttccgagatccgactccggagagtccacacggtccgacccgttgggctacggcccgtggttccaaacgggtcttaactcccgatttaccgnggttacctagagttcgggacttcggggacacggtaccgcag

SEQ ID NO: 101938 - DNA, 611 bp, Homo sapiens
  misc_feature: GYAE6OF02GU0U5.18.26.C04.1.454.CMB.1.raw
  modified_base (370)..(370): a, c, t, g, unknown or other
  misc_feature (370)..(370): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgcccctgagagccgaggactcggccgtttacactgtgcgagagactcccggcgatgcgtggcaccggctggtactacgtttgattccgtggggccagggaccctggtccnccgtctcctcacgtccctccaccgaacgggcccactccggttccttccccgtggcccgtcccgtcgccgtccgacggacgtccaccctcccggagacgccgaaccgacggccggcccgtcggggcctcggcccgtcgggtaccgtaacgggtaccttaccgttacccgtaagttacccttccggtaacgttacggacggtccggggtccgtacgggaccggaacgggtccgaccgtaacgg

SEQ ID NO: 101939 - DNA, 539 bp, Homo sapiens
  misc_feature: GYAE6OF02GL6TO.18.26.C04.1.454.CMB.1.raw
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactacgttgattccgtggggccagggaaccctggtccaccgtctcctcacgcctccaccacgggcccagtcggtccttccccnggccgccctgcctccgaggacnccaccctccgagacgcacgacggccggcccgtgggcctgccgtggaccaaggcctaccgttcccaactacctacgtactgaggcgggctggcaacgggcatacg

SEQ ID NO: 101940 - DNA, 699 bp, Homo sapiens
  misc_feature: GYAE6OF02JVV71.18.26.C04.1.454.CMB.1.raw
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (580)..(580): a, c, t, g, unknown or other
  misc_feature (580)..(580): n is a, c, g, or t
  modified_base (652)..(652): a, c, t, g, unknown or other
  misc_feature (652)..(652): n is a, c, g, or t
tcagtacgagtatgcacgaccggtgctcgatttagtctagcgactttgggtttgggttcccgtcagactctcctgtgcagcctctggattcaccttcagtaactactacatggcctggatccgccaggctccgagggaaggggctggagtacgtctcatacatcagtaacactggaaaataccataatacgtacgcagtactctgtggaggggccgattcaccatcgccagggacaacgcaaagtgctcacattancgtgcaagntgactgccctagagcggccgtaggacctcggtccgtttaacacgtggtagccgaaggacgacgtcccggngacttgccgtggcccgaccggtcttagggtaaccttacgtttgacgtttcccggtgggggacccaaccgggggtacccttggggttacccacccgggtttcctacccgtctacggacccctcccgaaaccgaccggggtacccctaacggtcccggttccccgttccccgtagggccctcccgttcgccgttaaccgcggaccgcccttaccgccggacgcggaccaccgtcggcccggtcccgngggtacctcggtccctacgggtaccaacgggttccttaccgttacccgtacgtttaccgtacggttaaccgnggtaccgggtcgggtccggtacggtacccggacggtccggacctagg

SEQ ID NO: 101941 - DNA, 683 bp, Homo sapiens
  misc_feature: GYAE6OF02JI47U.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccaggggaaggggctgggagtacgtctcatacatcagtaacactggaaataccatatactacgcagactctgtggacggggcgattcaccatcgccagggacaacgccaagagctcactattactctgcagatgactcgaccctgacgagccgaggacctcggtaccgtttactacgtgtacgccggaagaggtacgtccccgggagtacgtcgtcggtcgggcccaccgggtcgttcgggttaacttacgtttcgtactttccgggtcgggggacccgaacgggggtaacccttcgggtacccacccggttccctaccgtccacgtccccgtacccgaacccggaaccgggaccccgtaccgttcccgggttccccgtttcccccgtcgggcccggtccccgtccgtcccgtaccgaccggaccgcctacccgtaccgacggacgacctacgacggccggcccggtgggcctcggccgtggaccgtaacgactaccgtaccgtacgtaccgtcgtacgtcgacggcgggcgtacggacgaacgggtccgatacg

SEQ ID NO: 101942 - DNA, 652 bp, Homo sapiens
  misc_feature: GYAE6OF02GWTHP.18.26.C04.1.454.CMB.1.raw
  modified_base (249)..(249): a, c, t, g, unknown or other
  misc_feature (249)..(249): n is a, c, g, or t
  modified_base (333)..(333): a, c, t, g, unknown or other
  misc_feature (333)..(333): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccattcaccatccgccagggacaacgccaagagctcacattanctgcagatgactgccctgagagccgaggacctcgggccgtttactacgtgtgcgagagacgtcccggcgatgctggccaccggntggtaccttacgtttgacttccggtggggacccaacggggtacccttgggtacccaacccggttcctcccgttacgacgtccttcccgaaccgtaaccgggcccctacgttcccggttcccgtttacccccgtcggtcccgtcccctgccctccgacgggacgccgtacccgttcggtcggggccaccgacggtccggacccgtcgggccgttaccggccgttcggtaccgaacgggttacccttaccgttaccctaacgttaccctccggttaccgtcggacggtccgggcgttcgggacgacgggcgtcgacgtagg

SEQ ID NO: 101943 - DNA, 745 bp, Homo sapiens
  misc_feature: GYAE6OF02FF91A.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccgagggaaggggctggagtacgtctcatacatcagtaacactggaaataccatatactacgcagactctgtgaggggccgattcaccatccgccagggacaaccgccaagacgctcacattatctgcagatgactgccctgagagccgaggactcggccgttttactactgtgacgagagacttcccgggacgatcgcgtcggccgaccgggtcgttcgggttacctttacgtttcgacgtttccgtcggggggacccaacgggggtaaccctgggtaccctaacccggttccttccctaccgacgtacccctacccgaaccggaaaccgggtccccaacgttcccgggttccccttccccccgtagggccccgtaccccgtcgtcccgttacccgaacgggtaccgcccgtacccgttcccgaagggtaccgacccgaacggaccgggcccgggtcccgttacggggtccttccggtacccgttccgggtaaccgtaaacgggtaccccttaaccgttccccgtaaactttaccccgtaccgggtttaaccgtcgggtaaccgggtcccggggtacgttacccggggaccgtaaccgggtcccgaacgttaacgg

SEQ ID NO: 101944 - DNA, 544 bp, Homo sapiens
  misc_feature: GYAE6OF02H5DCQ.18.26.C04.1.454.CMB.1.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (424)..(424): a, c, t, g, unknown or other
  misc_feature (424)..(424): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctggagtacgtctcatacatcagtaacactggaaataccatatactacgcagactctgtgaggggccgattcaccatcgccagggacaacgccaaagagctcacattatctgcagatgactgccctgagagccgaggactcggtccgtttactactgtgcgagngactcccggnatgctggcaccggntggtactacgttgacttccgnggggccagggaccctggtccacgtctccgtcacgccctacgaccgacgggcccctagtccggtcccttccccgnggccgtccctcgcctccgaggacgcctaccgtccgagacgcacgacgccggcccgtgggcctcgctacggcaaggtcctactcccgtaatcctcgtactgacgcggnaggcaaggcanag

SEQ ID NO: 101945 - DNA, 653 bp, Homo sapiens
  misc_feature: GYAE6OF02IZRX4.18.26.C04.1.454.CMB.1.raw
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaagggctggagtacgtctcatacatcagtaacactaggaaataccatatactacgcagactctgtgagggccgattcaccatcgccagggacaacgccaagagctcacattanctgcagatgactcgcctgagacgccggagactcggtccgtttanacgtgtgcgtagagactcccggnatcgctggccaccggtntcggtactacgtttcgacttccggtgggccgaacgggtaaccctggtcccaacccggttctcccgtccgacgtcccctaccgaaccccggaaacgggcccctaacgttccggtccccgtttcccccgagggtccccgtccccgtacggtcctaccgaacgggtaccgaccctaacccgtcccggagaccgacctacgacggcccggtacccgtgggcctacggccgttacggacgtaaccggtaccttacccgttacccgaattacccgttacggtacctacggaacggtcgggtctacgggacgtaacgggcctagtaacg

SEQ ID NO: 101946 - DNA, 551 bp, Homo sapiens
  misc_feature: GYAE6OF02HI5Z5.18.26.C04.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactacgtgtgcgagagactcccgggnatgctggcaccggctggtactnttgattccgnggggccagggaccctggtccaccgtctccctcacgccctccaccgaacggcccagtccggtccttccccgtggcccgtccctcgcctccgacggcgccacccgtccgacgacgcacgacgccggcccgtcgggctcgcctggtcacggaccttacttcccgaatacctcgtacctggacgcgggcgtcggacgacggcgtacacg

SEQ ID NO: 101947 - DNA, 638 bp, Homo sapiens
  misc_feature: GYAE6OF02GFJAX.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccagggaaggggctgggagtacgtctcatacatcagtaacactaggaaataccatatactacgcagactctgtgaggggccgattcaccatcgccagggaacaaccgccaagacgctcacattatctgcagatgactgcccctgagacgccggaggactcggtccgtttactccgtaggtgcgagagactccggcgatgctggccaccggctggtactactttgacttccgtggggcccaacgggtacccgtggtccgtaccgtccgttcctccacgccctaccgaccgaacggcccacgtccggtcccttcccccgtcggtcccacccgtcgtccgttcccggacggtcgacctacccgaccggtacggacgccgaaccgaccgggacccgggtcccgtaccggggccttcgggtccgtcggtaccgtaacggtacccttaccgttaccctacgttaaccttccggtacgtacgacgggtccggtcgtccgggacgacggcgactaacg

SEQ ID NO: 101948 - DNA, 767 bp, Homo sapiens
  misc_feature: GYAE6OF02H8O6B.18.26.C04.1.454.CMB.1.raw
  modified_base (243)..(243): a, c, t, g, unknown or other
  misc_feature (243)..(243): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaggggctggagtacgtctcatacatcagtaacactaggaaataccatatactacgcagactctgtgacggggccgattcaccatcgccgaagggacaacgccaaagacnctacacattactctgcagatgactgcctagacgagccggagacgtcggtaccgtttactaacgtgtgacggagacgacgtcccggacgtatgcgtcggaccgaccggtctacggttaccttaccgttttgtaccgttccggtacgggggacccgaaacggggtacccttcggggtaccctacccggttccgtcccgtacgtacccgtacccctacccgtacccgaaaccggggtccccctaacggttccgtaccccgttcccgtcgggtaccccgtcccgttccgcccgttacccgaacgggtaccgtcccgtaacccgtccggaaccgtacggacccgtaccgtaccggccccgggtacccgttcggggtacccttccgggtaccgttacggggttaaccctaaaccggggtaccctttaaccccgtttacccggtaattaaccccggttaccggtaaccgttcgggtaaccgggtccgggtaaccggttccgggacccggtaaagggtccccgacgtaacgg

SEQ ID NO: 101949 - DNA, 669 bp, Homo sapiens
  misc_feature: GYAE6OF02JU6JQ.18.26.C04.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (524)..(524): a, c, t, g, unknown or other
  misc_feature (524)..(524): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggagggctggagtacgtctcaatacatcgagtaacacgtaggaaataccatatactacgcagactctgtgagggccattcaccntcgcgaggacacgcaaggnctcacattatctgctagatagacgtcgccctacggaagacggccgacggtaccgtccggtcccttttacacgtggtcgacggagacgtacgtccccggagtacgtcggtcgtcgggtccgaaccggtcgttaccgggttaacttaccgttgtacgttccggtcggggaccgacgggtaaccctgggtacctaccggtcccttaccctcgacggtccctaccgacccgaacggtcccctagtcccggttaccctcccgtcggcccgtccctgtccgcccgagacgtaccnccctcggaccgtcaccaccggcgtcccggcccgtcgggacctcgtaccgtggtaccgaaccggtccttacccgttcctacgttacccggtagtacccgtagggacccggcgggtacttccgggaacgtcggggaccttaccgaag

SEQ ID NO: 101950 - DNA, 717 bp, Homo sapiens
  misc_feature: GYAE6OF02FUJ08.18.26.C04.1.454.CMB.1.raw
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaggggctggagtacgtctcatacatcagtaacactggaaataccatatactacgcagactctgtgaggggccattcaccatccgccagggacaacgccaaagagcctcaacattatctgcaacgatcgaactcgccctaggagacgccggaggacctacgggtccttttaacacgttggtcgcgagagactccggganactcgcgttggacaccggngttacgtacttacgttgacgttccgtagggggaccctaagggtaccctggtaccacccggttctccgtacgacgtccctaccgaaccgaccgggccctacggtcccggttcccttcccccgtaggccccgtaccccgtcggacccgttaccggaacggccgtacccgtacccgttaccggaacggaccgtccgaacgacccgggtccggtacccggtaggggaccttcgggcccgttacgggtaaccggtaacgggtacccttaacccgtttacccgaacgttaaccggttcccgtaacggttaccggtaaccgggtaccgggtacgtaccgggtacccggaacgggttacccgacgttaaccgg

SEQ ID NO: 101951 - DNA, 697 bp, Homo sapiens
  misc_feature: GYAE6OF02F8WBG.18.26.C04.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (532)..(532): a, c, t, g, unknown or other
  misc_feature (532)..(532): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaactccatatactacgcagactctgtggaggggccattcaccatccgaccagggaccaacgccaaagngctcacattatcngcagatgactcgccctagacgacgcccgaaggcctcgggtacccttttaacaccgtggtacggacgagacgacgtcccggacgtatcggcgtcggccgaaccggtcgttacgggttaccttaacgtttggaactttcccgggtacggggcccgtaacggggtaaccctggggtacccacccggtctaccgtcacgtccctaccgaaccgacgggtccctacgtcccggttccttccccgtggtcccgtcccgtcgaccgttaccgacgggacgacccncccgtacgaccgacgacctaaccgcgggcccgggtccgtaggggtcctccgggtcgtacggtacccgaacggtacctttacccgtaacctaccgtttaccgtaccggtaccgtcgggaaccggcggggttaaccggtcggacccggaacggtccgtaacgtaagg

SEQ ID NO: 101952 - DNA, 618 bp, Homo sapiens
  misc_feature: GYAE6OF02GHI1E.18.26.C04.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (443)..(443): a, c, t, g, unknown or other
  misc_feature (443)..(443): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccattcaccatccgccagggacaacgccaaagngctcacattatctgcagatgactgccctgagagccgaggacctcggtccgtttacactgtgcgagagacgtcccggnatgcgtggccaccggcttggtacttacgtttgactttccggtggggcctaacggggtaaccctggtccacccgttctccctcgacgccctaccgaccgaacgggccctacgtccggtcccttccccgnggcccgcccgtgcctccgaggaccgccacccgtcggagacgaccacgacgggcccgcccgtgggcctcggccgttacggacgaacggttcctaccttacccgtaattacccggttaccgttacgtagggccggtaccggggtccgtaccgggacgaaccgggtccgtactaacgg

SEQ ID NO: 101953 - DNA, 1052 bp, Homo sapiens
  misc_feature: GYAE6OF02JALJC.18.26.C04.1.454.CMB.1.raw
  modified_base (197)..(197): a, c, t, g, unknown or other
  misc_feature (197)..(197): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccgaggggaagggcgtggagtacgtcgtcatacatcgaagtaacactaggaaataccatatactacganagactcgtagtggacggggcctacttccacctatccggacccgaagggaaccgtaaaccgacctaaaggacgaccttaccaacctaatttacctcgtacgtaccaagtctacgaccgtccgaccccgttaggaacggaaccggcccggtaacgggtaccgttaccccggggttacccgtttttaaccggtaaccggtttgggttacggtaaccggtaaacgggtaacgttaacccgggtcccccggggaaacgtaacggttaccgggaccgggttccggggaacccgggtaaaccccgggtttaccgggttacggggttttaaaaccccgtttttaaccggggtttaccggttttaacccgggttttaccccgggggttaacccggggggtaaccccggttaaaacccgggggttttaccccgggttaccgggttaacccccggtttaaccccgggttttccccttaaccccggtaacccgtttaccccggtaacccccccgtaccccggtaaaacccccggtaaacccggggtaaccccccttaacgggtttaccccccggtttccccccggtttcccccgggtacccggggttcccccgtttaccccccgggtcccgtaccccggttacccggaacccgggttacccgtaccccggttaaccccccggtacggaacccggtacacccggggaacccgcccggtacccggggtcccgtaaccggggttcgttacccggtccgttacgggtaccgtaacccgtaccgttaccccgttacccgtaacccgttacggttacgtacccgtaggtaccggtaccggttcggaccggtaccggaccggtacgcgtaacgg

SEQ ID NO: 101954 - DNA, 805 bp, Homo sapiens
  misc_feature: GYAE6OF02JYLAU.18.26.C04.1.454.CMB.1.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
tcagtacgagtatgcacgaccggtgctcgatttagtctagcgactttgggtttgggtccctcagactctcctgtgcagcctctggattcaccttcagtaactactacagtggcctggatccgccaggctccgagggaagggctggagtacgtctcatacatcagtaacactgaaatacatatactacgcagactcgtgtaggacggggccgtattccgaacctatccggaccaacggggaaccaaaccggacccgaaaggacgtcctaccgaatactttanccttacggctaagtaacgtgaacctcgaccctgagggacgccggaagccggtaccgggttcccttttaangttacgtcgacgaggtagtaccggtacccggngtagtcggccgtagggacccacccgggtgttacgggttaaacttcgttttacggaactttcccggacggggggtacccgaacccggggttaaccttacgggtcccttaaccggtttcccacccgtacccgtacggtaccccctaccccggaaccggtaaccgggtccccgtaaccggtttacccggtttccccgttaccccggtcggtacccgtccccgtacgtccctaccgggtacgaccggtacccttccccgaaccgggtagacccgtccgtaccgacggcccgggttaccggcggttacctccggccggtttagacccgggtaaccgttaccttaccctacgaccgtttacccgtagtaccgtccgggtagggtcccccggtaagggtccggtaaccgggccgggtacgtacgacggg

SEQ ID NO: 101955 - DNA, 639 bp, Homo sapiens
  misc_feature: GYAE6OF02FXAH4.18.26.C04.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggaaggggctgggagtacgtctcatacatcagtaacactggaaataccatatactacgcagactctgtgaggggccattcaccatcgccagggacaacgccaagngctcacattanctgcagatgactgccctgagagccgaggctcggccgtttacnctgtgcgagagactccggnatgctggccgaccggctggtacctacgttgacttccggtcggggaccgacgggtacccgttggtacctacccgttcctcctccgacgtccctacccgaacccgacgggcccctacgttcccggttccccttcccccgtcggtcccgccccgttcggcccttaccggacggacgcccgaccctccggacgacgaccacgacggcccggcccggtgggccgttccggaccgttcggaccgtaacggtaccttacccttacccgtaacttacccgttaccggtaccgttcggaccgggtccggtacggtccggacgacgggccgagtaacgg

SEQ ID NO: 101956 - DNA, 775 bp, Homo sapiens
  misc_feature: GYAE6OF02HFSBE.18.26.C04.1.454.CMB.1.raw
  modified_base (387)..(387): a, c, t, g, unknown or other
  misc_feature (387)..(387): n is a, c, g, or t
tcagtacgagtatgcacgaccggtgctcgatttagtctagcgactttgggtttgggtccctcagactctcctgtgcagcctctggattcaccttcagtaactactacatggcctggactccgccaggctccaaggggaagggctggagtacgtctcatacaaatcaagtaacacgtggaaataccatatacgtacgcagactctggtaggacgggcctattcacctatcgccgagggaaccaacgcctaaaggcgctacaactaatttactctgacgaagattcgaaccttcggcccctaggaacgacggacccggtaagggtacctcccgggttacccgttttacctaacgtggtacggacggaacgacgtaaccggtccccgggngtaattcggcgttacgggcccgtaaccggctttacgggtaacctttacgttttagacgtttcccggcgggggaacccgtaaacggggtaaccccttggggtaacccctacccggttccttacccctacggaaccgtcccgtacccaacccggtaaccgggccccttaccgggttccccgtttccccgttacccggccggtccccggtaccccgtcgtaccggttaaccgacggtccgaccgtaccggtaccacggaccacgaccgtaccgggccgtcccggtcggtcgccggtcgtaccgggtaacgaccgtaccttcccgtactaacggttaccctcgtaaccggcggtcgggtcggtcggtacggccggtaacgccgtaataccgg

SEQ ID NO: 101957 - DNA, 692 bp, Homo sapiens
  misc_feature: GYAE6OF02GMVNW.18.26.C04.1.454.CMB.1.raw
tcagtacgagtatgcacgaccggtgctcgatttagtctagcgactttgggtttgggtccctcagactctcctgtgcagcctctggattcaccttcagtaactactacatggcctggatccgccaggctccgagggaaggggctgggagtacgtctcatacatcagtaacactaggaaataccatatactacgcagactctgtggaggggccgattcaccatcgaccgagggacaacgccaaagagctcacattactctagcagatagactcgccctgagacggccggaggaccgtccggtaccgtttactacgtggtgacggagacgacgtcccggcgagtcgtcgtacggcgaccggcttacggtactttacgtttgtaccttccgggccggggaccggtaacggggtacccgtggtcccgtacccggttccctacccgtccgtacccgtccctaccccgaaccggtaacggggacccccttcggttccccggtttcccgttaccccgggtccggtccccggtccccgtccggtcccttaccggaacggtcgacccctacccgtcgaacggaccgacacgaccggcccggccgtacgggctcggtccgtaggtaccgaacgttacctaccgttccgaatacccgttcggttacacggtacgggccggtacgtcggaacggcggacgatacg

SEQ ID NO: 101958 - DNA, 621 bp, Homo sapiens
  misc_feature: GYAE6OF02GF3DY.18.26.C04.1.454.CMB.1.raw
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
  modified_base (496)..(496): a, c, t, g, unknown or other
  misc_feature (496)..(496): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgagggccgattcaccatcgccagggacaacgccaaagagctcactattatctgcagatgactcgcctgacgagcgagactcggcctttaactctgtcgacgacgagacgtccggacgatgcgtacgacgaccggtntggtactacgttgacttcgnggggccagggaaccctgggtcctaccggtcctacctcgaacgccctaccaccgacggacccctacgtccggttacccgttcccctacgggtcccgcccgtcgtaccgttaccgacggtaccgaccgacccgtcgacggacnccgaaccgacggcccgaccgtcgggcttccggccgtacggttaccgaacggtaccttaccgttaccgacgttaccgtcgtaacgtacggtacggtcgggacgtacggacgacgggtaccagtacg

SEQ ID NO: 101959 - DNA, 733 bp, Homo sapiens
  misc_feature: GYAE6OF02HZ3US.18.26.C04.1.454.CMB.1.raw
  modified_base (417)..(417): a, c, t, g, unknown or other
  misc_feature (417)..(417): n is a, c, g, or t
  modified_base (721)..(721): a, c, t, g, unknown or other
  misc_feature (721)..(721): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctccaggggagggctggagtacgtctcatacatcaagtaacactagaactacatatactacgcagactcgtgtggagggccgtattccaccagtcgaccgacgggacaaccgcaagacgccacaactattatctgcaggtatacgtaccgtcgtaccgtgaacgtacggaccggacggtaccgtaccggtacgtttaaccgtacgtaggtgacggagacacggtacccggacgtagtcgacgtccggaccgtaccggtacgttcgttaacttacgttacgtacgttccggngggaacccgtaaccggggtaacccgttggtaacccgtacccggttaccttacccgacgtacccgtaccccgtaacccgaaacccggtacccggtaccccgtaccgtttcccggttaccccggttccccgtacggtacccgtcccgtaccgtcccgtaaccggaccggacacccgtacccgacggacgacgaccgacgaccggcccggtaccgtcggaccgttcggacgttacggaccgaacgttacctacccgtaccgtacctaaccgttcgtaacggtcgacgggcggtacgacgggaaccgngtaccgagtacg

SEQ ID NO: 101960 - DNA, 771 bp, Homo sapiens
  misc_feature: GYAE6OF02IGI2S.18.26.C04.1.454.CMB.1.raw
tcagtacgagtatgcacgaccggtgctcgatttagtctagcgacttttgggtttgggtccctcagactctcctgtgcagccctctggattcaccttcagtaactactacatggcctggactccgccaggctccgaggggaaggggctggagtacgtctcatacatcagtaacactaggaaactaccatatactacgcagactctgtggagggcattcacatcgccgagggacacgaccaagagctcactattatcgtgcagatgactcgccctagagacgccggaggaccgtccggttaccgtttacgttaacgttgggtacgacgggaagacggtaaccggtccccgggacgtacgtcggccgtacgggtacccgacccgggtcgttacgggtttaacctttaccgttttgtaccggttcccgggtcggggaacccggtaaccggggacccgttcggtacccgtacccgtttcctccccgtacgacccgtacccgtaccctaccgggaaccggacccctacggttcccccggtttcccgttccccgcgggtcccctacccggttcgacccgttaccggaccgggaccgccccgttacccgtacggaaccggaccgaccgaccggacccggtcccggggtacccggtccggggtacgtccggtacgtacggttccggtaaccgtaacgtaacccgttttacccgtacccgtaaccttaccgtaccgttacgtcggacggtccggcggtacggacgggtaccggccgtaacg

SEQ ID NO: 101961 - DNA, 732 bp, Homo sapiens
  misc_feature: GYAE6OF02F63V7.18.26.C04.1.454.CMB.1.raw
  modified_base (226)..(226): a, c, t, g, unknown or other
  misc_feature (226)..(226): n is a, c, g, or t
  modified_base (524)..(524): a, c, t, g, unknown or other
  misc_feature (524)..(524): n is a, c, g, or t
  modified_base (716)..(716): a, c, t, g, unknown or other
  misc_feature (716)..(716): n is a, c, g, or t
  modified_base (728)..(728): a, c, t, g, unknown or other
  misc_feature (728)..(728): n is a, c, g, or t
tcagtacgagtatgcacgaccggtgctcgatttagtctagcgactttgggtttgggtccctcagactctcctatgcagcctctggattcaccttcagtaactactacatggcctggactccgccaggctccgaggggaaggggcgtggagtacgtctcatacatcaagtaacactaggaaactaccataactactacgcagactcgtgtggaggggccattcaccntcgacgaggacaacgccaagcgctcactacttatctgacagtagtcgactgcccgtagacgacggaccgaggaccgtcggtacctttactacggtgtacggacgacggagtaccgtccggacgtacgtcgcgtcggaccgtacggtcgttacggtacttcgtttcgtaccggttccggacggggaccgtaaccgggtccgttacggcctacccgtcctacccgcgtaaccgtacccaccgaaaccggacccgggtcctaccgttccggttaccccttccccggaccggtcccgtcccncccggtacctaccggacgtacccgacctaccggtaaccgacggaccgaccgtaaccgccgggtccccgtaccggtacgggtccgtaaccggtccgtacggggttacgtaaccggttacccttaacccgtacccgtaaccgtaccgttacgtaaccggtcggtaccgggtacgggtccggtagggtaacccgngtacccggtaanacgg

SEQ ID NO: 101962 - DNA, 728 bp, Homo sapiens
  misc_feature: GYAE6OF02GJOG5.18.26.C04.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagtacgagtatgcacgaccggtgctcgatttagtctagcgactttgggtttgggtccctcagactctcctgtgcagcctctggattcaccttcagtaactactacatggcctggatccgcaggctccagggaaggggctggagtacgtctcatacatcagtaacactggaaataccatatactacgcagactctgtgagggccaattcaccatccgaccagggacaacgccaaagngctcacattanctagcagangactgccctgagagccgaggtactcggtaccgtttactactgtgacgaagagactcccggcgatcgctggaccaccggtctcgggttaacttaaccgtttggtaacgttacccgtagggggacccgaacgggggtaaacccctgggttaccctacccggttaccgtacccttacgacgtcccctacccgaaaccccgtaaacggggaccccctaacgttcccgggttcccctttaccccccgtacgggacccgtcccccgtacgtcccttacccgaaccgggacgtcccgaacccgtacccggaacgtacggaccgaacccacgggacccgggacccggtcggggtaccgttcggtacccggttacggtaaccgtaacgggtaccttacctttaaccccgaactttaccgtacggttacgttacggacggtacgggccgttacggaccggtaacggaccggtacgtaacg

SEQ ID NO: 101963 - DNA, 723 bp, Homo sapiens
  misc_feature: GYAE6OF02J1NY7.18.26.C04.1.454.CMB.1.raw
  modified_base (323)..(323): a, c, t, g, unknown or other
  misc_feature (323)..(323): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
tcagtacgagtatgcacgaccggtgctcgatttagtctagcgactttgggtttgggtccctcagactctcctgtgcagcctctggattcaccttcagtaaactactacatggcctggatccgccaggctccgaggggaaggggctggagtacgtctcatacatcagtaacacgtggaaactaccataatactacgcagactctgtgagggcattcaccatcgccaggacaacgcgaaagagcctcaacattatcgtgcagatgactcgccctgagacgtccggaggaaccgtcggttaccgtttacaccttggacgtacgganaacgtaccgtccggtccgatcggcgtcgggtccaccggttacttacgggttaactttaccgtttggtaaccgtttccgggtcgggggaccccgtaaacggggttacccgtcggtccgtaccccgtccgttacccncggtaacccncccgttacccgacccgaaccggtccgtaccgtcccggttcccttccccggtcggcccgtccgtccgttaccggccgtacggaccgtcccacccgttccgacggtaaccgacgtaccgtccgggccggtcccggtccggtacgtccgtaccggttacggtacgtaaccgttccgtaacccggttcccgtaacgttacccttcgtcgttaacggtcgggtaccggtccggttaccgacggtaccggacgacgtacgg

SEQ ID NO: 101964 - DNA, 695 bp, Homo sapiens
  misc_feature: GYAE6OF02H6Y32.18.26.C04.1.454.CMB.1.raw
  modified_base (247)..(247): a, c, t, g, unknown or other
  misc_feature (247)..(247): n is a, c, g, or t
  modified_base (452)..(452): a, c, t, g, unknown or other
  misc_feature (452)..(452): n is a, c, g, or t
tcagtacgagtatgcacgaccggtgctcgatttagtctagcgactttgggtttgggtccctcagactctcctgtgcagcctctggattcaccttcagtaactactacatggcctggatccgccaggctcaggggaagggctggagtacgtctcatacatcagtaacactaggaaataccatatactacgcagtactctgtggaggggcgattcaaccatcggccaagggacaacgcaaagagcctanacatttatctgacagtatgaccgtgacccctgacgtagaccgaggactctcgtcccgtttaactacgttgtgcgtacgagacgtcccggagacgttcgtcggtcgggtaccgaccgggacgttcggtaacttacgttttacgtagtttcccgggtcggggaccggtaacgggtaccccgtggtcccgaaccgttcctaccctacncgtccctaccctaccggaaccggacccgtacgtacccggttccttcccccgtccgggtcccgtcccgtccgacctccggtacggacgtcccaccgccgtacgcgacctaccgaccggaccggtcccggtccggtccgtccggaccggtcgggtaccgacggtaccctaccgtcccttaaccgttaccttaaccggttacctggaccgggtccgggtcggtacggacggtaccggtccggaacg

SEQ ID NO: 101965 - DNA, 800 bp, Homo sapiens
  misc_feature: GYAE6OF02ILVWM.18.26.C04.1.454.CMB.1.raw
  modified_base (75)..(75): a, c, t, g, unknown or other
  misc_feature (75)..(75): n is a, c, g, or t
  modified_base (158)..(158): a, c, t, g, unknown or other
  misc_feature (158)..(158): n is a, c, g, or t
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (342)..(342): a, c, t, g, unknown or other
  misc_feature (342)..(342): n is a, c, g, or t
  modified_base (464)..(464): a, c, t, g, unknown or other
  misc_feature (464)..(464): n is a, c, g, or t
tcagtacgagtatgcacgaccggtgctcgatttagtctagcgacttttgggtttgggtccctcagactctcctgngcagccttctggattcaccttcagtaactactacatggcctggactccgccaggctcgaggggaagggctggacgtacgtctnatacatcagtacactagaaatacatatactacgcanactcgtgtggacgggcctattccacatcgcaaggaccacgaccaagngctcgactattntctgctagatcgactcgcctgacggacgccgaaggccgtccggtttaaccttacgtacgttcggtcgacggtaggactaccggtccggnggtactcggtccggtaggcccggtaccgtacggttacggttaaccgtttacgtttcggttaaccggtccggggttcgggaaccgttaaccgggtaccgtcggtaccgtacctctcccgtacnccgtccctaccgaaccgaccggtccctacggttacccgttccccgttcccggtcggccccgttaccccggtccgtaccgttacccggaacgggacccgtacccgttaaccccggtaacggaccggtaaccggtacccggaaccgtaccccggggtacccggtccgggttccgggtaccgtttaacccggtccgggtaacgggttaacccgaaccgggtttacccttacccgtttcccgggttaaaaccgtcccgtttaacggtttaccgaccgggggttaccgggaccggttcccgggtaacggggttacccggaaccgggtcctaagggttaccg

SEQ ID NO: 101966 - DNA, 787 bp, Homo sapiens
  misc_feature: GYAE6OF02JCK6D.18.26.C04.1.454.CMB.1.raw
  modified_base (163)..(163): a, c, t, g, unknown or other
  misc_feature (163)..(163): n is a, c, g, or t
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagtacgagtatgcacgaccggtgctcgatttagtctagcgactttgggtttgggtccctcagactctcctgtgcagcctctggattcaccttcagtaactactacatggcctggactccgccaggctccaggggtaaggggctggagtacgtctcagtacntcaagtacactggaaactaccatatactacncagacgtctggtggacgggccgtattcgacccatccgccgaacgggaccaacggccaaaggcgtcctcaactattactctgacgagatcgactcgtcccgtagagacgccggaaggccgtaccggtccgtttactacgttggtacgcggagtacgccggtcccgngtacttcggaccgtgggccgtaccggcgttccggttaacgtttcgttacggtacgttcccggacgggggtaccaaccgggtaaccgtccgggtactacccgttcccgtcccgtacgtaccgtcccgtacccgtaacccggaaccgggtaccccgtaccgttccccggtttacccttcccccgtcgggtccccgtacccgtccgtaccgtcccgacgggacctccgacccgtaccggtacgacggtaccgaccgaaccgggcccggttaccggacccgggtaccgttcgggtaacccgttacgggaccgttaaacccgggtaccgtttaacccgtacccggtaacggttaacccggttaccgtaacggtacccgggttacgggaccgggtaccggtaccggtaaccggacggtaccggtaacccgtagg

SEQ ID NO: 101967 - DNA, 865 bp, Homo sapiens
  misc_feature: GYAE6OF02J1OYM.18.26.C04.1.454.CMB.1.raw
  modified_base (234)..(234): a, c, t, g, unknown or other
  misc_feature (234)..(234): n is a, c, g, or t
tcagtacgagtatgcacgaccggtgctcgatttagtctagcgactttgggtttggggtccctcagactctcctgtgcagcctctggattcaccttcagtaactactacatggcctggatccgccaggctccagggaaggggctgggagtacgtctcatacgatcagtaacactggaaactaccagtactacgtacgcagtactcgtcggtaggcgggggcctagttcacctacncgaccgaaggggaccaaccggtccgaaaggcgtccttacaccgttagttacgttccgcggaccgtaagcgtagtccggttcgccgtaggacggacggcggaccggtacgtaccggttccgtttaaccgtcgtcgttaggacgaacggtacgtccgaccgggtcgtaaggtcggtacgtcgggaccgtaccgggtacgttacggttaaactttcgttacgtccgttaccgggttacgggggacccgttaacgggtaaccggttccggtcgtaacccgtttcctaccggtaacgcccgtacccgtaacccgtaaccgggaccggtacccgttaccggtcccggttcccgttacccccgggcgggttacccggtccctcgtcccggtaaccggtaccgggtacctacccggtaaccgtccgggtaacgtacccggttaaccgaccggttaaccggggcccggttaacccggggtccggttccgggtcgtaccggggtaccggttaacgggtaaccgtacccgtttaacccgttaccgttaaccgttaccggttaccgttaacgggacccgggttccgggtccgggttaacccgggacggtaacccggggtaccggttacggtacgttaaccggg

SEQ ID NO: 101968 - DNA, 775 bp, Homo sapiens
  misc_feature: GYAE6OF02JGR4Z.18.26.C04.1.454.CMB.1.raw
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagtacgagtatgcacgaccggtgctcgatttagtctagcgactttgggtttgggtccctcagactctcctgtgcagcctctggacttcaccttcagtaactactacatcggcctggatcccgccaggtcctccgaaggggaagggctggacgtacgtctcgataccatcagtaacactggaaactccatacactacgcaagactcagtggagggcctatcaccatcgacgaggacaacgccaagngctacgacattaagtctgacctaaggatacgccgttaccggaccccttggtaacggacggcccgaaagggtaccgtaccggtaccgtttaaccaacgtgtcggacgtacgacgtacgtcccggntacgacnccgtagggcccctaacgggccttaaacgggttacttaacgttttcgaactttcccggggacgggggaacctaaccggggaaccgtttcgggacccttccggtaccctcccggtactacccgggtaccctacccgtaaacccggaaccggacccgttaacggtcccggttcccgtttacccggtccggcccgttaccccgtacgtcctaccggtaacgtaccggaccgtcccgtaacccggaagggacccaaccgggaacgaccggtcccggcccgtgggtcctcgggtaccgtacggtaaccgtaaacggtcccttaacctacccgtacgttaaccggttacccgtaacgtgggaacggtccgggtcgtaccggacggaaccggttccaacgtacgg

SEQ ID NO: 101969 - DNA, 528 bp, Homo sapiens
  misc_feature: GYAE6OF01DO12J.9.33.C11.1.454.CMB.1.raw
  modified_base (203)..(203): a, c, t, g, unknown or other
  misc_feature (203)..(203): n is a, c, g, or t
  modified_base (514)..(514): a, c, t, g, unknown or other
  misc_feature (514)..(514): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagtattttgctagtttattactgtacaactatcgtaccgagtcggccgtccggggtcctacgtttccggccctagggaccaaagttgagtatacaaacgactggtgctgcaccatctgtcttnacttctcccgtacc

SEQ ID NO: 101970 - DNA, 582 bp, Homo sapiens
  misc_feature: GYAE6OF01CWUD0.9.33.C11.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccgaaggggaaancgccaccctctcctgcagggccagtcagagtgttaccaccagttagcctggtaccaacacaaacctggccaggcctccaggcccctnatcttgatgcatccatcaggccactggcactcccagccaggttcagtggcagtggtctgggacagtacttcactctcaccatcagcagcctagacgcctagaagtatttgactagtttatactgtacaactatacgtacgaggtcggccgtccggggtacctacgtttccgggacccgtacgggaacctaaacgttcgaacgtactaccgaaaaccgtaacgtcggtacggtactacggcctaaccgtacttccgttacgttacttacctaccttcccgttccccggtacc

SEQ ID NO: 101971 - DNA, 549 bp, Homo sapiens
  misc_feature: GYAE6OF01A1AL3.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatcttgatgcatccatcagggccactggcatcccagccaggttcagtggcagtgggtctgggacagacttcactctcaccatcagcagcctagagcctagaagtattttgctagtttattactgtcaactatcgtacgagtcggccgtccgggggcctacgtttccgggcccgtacgggacctaaagttcgaagactacgaaacgtaacgtggtcggctgccaccctattctcgttcttactacttccttcccgtccc

SEQ ID NO: 101972 - DNA, 522 bp, Homo sapiens
  misc_feature: GYAE6OF01BRAEF.9.33.C11.1.454.CMB.1.raw
  modified_base (291)..(291): a, c, t, g, unknown or other
  misc_feature (291)..(291): n is a, c, g, or t
  modified_base (511)..(511): a, c, t, g, unknown or other
  misc_feature (511)..(511): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatcttgatgcatccatcagggccactggcatcccagccaggttcagtggcagtgggtctgggacagacttcactctcaccatcagcagcctagagcctgaagtatttgctagtttattactgtcaacatcgtaccgagtcggccgtccggggcctacgtttccggcccgtgggacctaaattgagatacaaacgaacgtgtggctgcaccatctcgtctnactctcccgcc

SEQ ID NO: 101973 - DNA, 571 bp, Homo sapiens
  misc_feature: GYAE6OF01D6BSO.9.33.C11.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgctccaggggaangccacctctcctgcagggccagtcagagtgttaccaccagttagcctaggtaaccaacacaaacctggaccaggcctcccaggcccctnatcttgatgcatccatcgacgggccacgtggcactcccagccaggttcagtggcaggtggtctgggacagcttcactctacaccatcgagcacgcctagacgcctagaagtatttagacttagtttattactgtacaactactacgtacgtagtcggccgtccggggtcctaccgttccggacccgtacggaacctaaagttcgagtaactacgaaacgtaacgtggtacggtctacgaccaccgtacttacttcgttacttacctacttccttcccgtacc

SEQ ID NO: 101974 - DNA, 530 bp, Homo sapiens
  misc_feature: GYAE6OF01CUOTS.9.33.C11.1.454.CMB.1.raw
  modified_base (501)..(501): a, c, t, g, unknown or other
  misc_feature (501)..(501): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcacatcagcagcctagacgcctgaagtattttgactagtttattactgtacaactatcgtacgagtcggccgtccggggcctaccgtttccggcccgtggacctaaattgaacgtatacaaacgactgtcgntgcacatctcgtcttcactcgtcccgacc

SEQ ID NO: 101975 - DNA, 563 bp, Homo sapiens
  misc_feature: GYAE6OF01CVULQ.9.33.C11.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtgagctcggttggggtttgggggaggaactgctcagttaggacccagagggaaccatggaagccccagctcagcttctcttcctcctgctactctggctcccagataccaccggagagattgtgttgacacagtctccagccaccctgtctttgtctccagggggaaangccaccctctcctgcagggccagtcagagtgttaccacccagttagcctggtaccaacacaaacctggaccaggcctcccaggcccctcatctttgatgcatccatcgagggccacgtggcactcccagccaggttcaggtggcaggtgggtctgggacagacttcactctcacatcagcagcctagacgcctagaagtattttgacttaagtttattactgtacaactatcgtacgagtcggccgtccggggcctacgtttccgggcccgtacgggaacctaaagttgaacgatacgaaacgacgtggtcggctcgccaccgtattcttcgttccttacaccttccgttcccgtac

SEQ ID NO: 101976 - DNA, 555 bp, Homo sapiens
  misc_feature: GYAE6OF01A9GB7.9.33.C11.1.454.CMB.1.raw
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctnatctttgatgcatccatcagggcccactggcatccccagccaggttcagtggcagtgggtctggggacagacttcactctcaccatcagcagcctagagcctagaagtattttgctagtttattactgtcaactatcgtacgagtcggccgtccggggcctacgtttccggcccgtagggaacctaaagttacgagtaactacgaaacgtaacgtggtcggctacggccacctatctcgttacttacacttccttcccgtacc

SEQ ID NO: 101977 - DNA, 545 bp, Homo sapiens
  misc_feature: GYAE6OF01A39EJ.9.33.C11.1.454.CMB.1.raw
  modified_base (203)..(203): a, c, t, g, unknown or other
  misc_feature (203)..(203): n is a, c, g, or t
  modified_base (427)..(427): a, c, t, g, unknown or other
  misc_feature (427)..(427): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggcctcccaggcccctcatcttgatgcatccatcgacgggcccactggccactccccagccaggttccaggtggcaggtgggtctggggacagtacttcactctcacctatcagcagcctagacgctagaagtatttgactagtttatactntcaactatcgtacgagtcggccgtccggggcctaccgttccggccgtggaacctaagtgagactacaaacgtactaggtcgtgtcgccacattctcgtcttctacttccttcccgacc

SEQ ID NO: 101978 - DNA, 585 bp, Homo sapiens
  misc_feature: GYAE6OF01CS19Z.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgagggggaaagacgccaccctctcctgcagggccagtcagagtgttaccaccagttacgcctggtaaccaacacaaaccgtggccaggcctcccgacggcccctcattctttgatgcatccatcgagggcccacgtggcactcccagcctaggttcagtggcaggtgggtcgtggggacagtacttcactctacacatcagcagcctagacgcctagtaagtatttagcttaagtttattactgtacaactatacgtacgtagtcgggtccgtccgggggcctaccggtttccgggacccgtacgggaacctaaagttgaagactacgaaaacgtaactggtcggacgtcgcacctattccgtacgttcttactacttccgttcccgtacc

SEQ ID NO: 101979 - DNA, 646 bp, Homo sapiens
  misc_feature: GYAE6OF01DICVX.9.33.C11.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccacggagagattgtgttgacacagtctccagcccaccctgtctttgtctccgaggggaaancgccaccctntcctgcagggccagtcagagtgttaccacctagttacgcctaggtaccaacacaaacctggaccaggctcccaggcccctnatcttgatgcatcatcagggccacgtggcactcccagcctaggtcagtggcaggtggctgggacagtactcactctacaccatcagcacgctagacgtcctagtaagtatttcgacttagtttattactagttacaacgtacgttacggtaaccggtaggtccgggacccggttcccgggggacccttaccgggtttccgggtaccccgttaacgggaaacctaaaacggtttcggaacggtaactaaccgtaaaaaccggtaacgttacgggtacggtaccggttacgtacccgaacccgtacttaccgttcgttacccgtttacctacctttcccgttccccggtaaccc

SEQ ID NO: 101980 - DNA, 537 bp, Homo sapiens
  misc_feature: GYAE6OF01EH39R.9.33.C11.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnatcttgatgcatccatcagggccactggcatcccagccaggttcagtggcagtgggtctgggacagacttcactctcaccatcagcagcctagacgcctagaagtatttgctagtttattacttgtacaactatcgtacgagtcggccgtccggggcctacgtttccggcccgtacgggaacctaaagttgaagatacaaacgaactgtcggtntcgcaccatctcgtcttacnctcctcccgtcc

SEQ ID NO: 101981 - DNA, 544 bp, Homo sapiens
  misc_feature: GYAE6OF01AJ6QO.9.33.C11.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnatcttgatgcatccatcaggccactggcactcccagccaggttcagtggcagtggtctgggacagacttcactctcaccatcagcagcctagacgcctagaagtatttgctagtttattactgtacaacatcgtaccgagtcggccgtccggggcctacgttccggcccgttacggacctaaagttagacgactactaaaccgacgtagtcggtctagcacctacttctcgttctactacttcctcccgtacc

SEQ ID NO: 101982 - DNA, 572 bp, Homo sapiens
  misc_feature: GYAE6OF01EG9AR.9.33.C11.1.454.CMB.1.raw
  modified_base (293)..(293): a, c, t, g, unknown or other
  misc_feature (293)..(293): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttacgcctggtaccaacacaaacctggccaggcctcccaggcccctnatcttgatgcatccatcgaggccactggcatcccagccaggttcagtggcagtgggtctgggacagacttcactctcaccatcagcagcctagagcctgaagtattttgactagtttattactgtacaactatcgtacgtagtcggtccgtccggggtccctacgtttccgggtccctacgggtaacctaaagttagagaacgtacgaaacgaacttaggtcggtctacgtccgaacctattaccgtcgttaccgttactacgttccctccccgtaccc

SEQ ID NO: 101983 - DNA, 640 bp, Homo sapiens
  misc_feature: GYAE6OF01BYGJN.9.33.C11.1.454.CMB.1.raw
  modified_base (311)..(311): a, c, t, g, unknown or other
  misc_feature (311)..(311): n is a, c, g, or t
tcagtgatacgtctcacgaccggtgctcgatttagagtgagctcgtggggagagggagcccagcactagaagtcggcggttgtttccattcggtgatcagcactgaacacagaggactcaccatggagtttgggctgagcttgggtttcctcggttgcttcttttaagaggtgtccagtgtcaagtgcaactggtggaggtcgtggggggggctggtccagccgtgggacgtccctgagtactctcctgtcgctaggtctcgtggtacttcaccttacgagtaacgtcggcgtgcctacgtcggggtaccnccaggcctccgaggccgaagggcttgggagtcggcctggctaggtttcgttacacgttccgtaggaagggtattagttacgtaaattacctaataccgaaggtacctacggtaggaacgggccctaatccactactacctacgaacgactactaactacaaagaacagtatagtactcagacaagtcgaacacgtactaagtagtacgacggtacgacgttacttacgttacgttacgtaggtaaacggtaagggtaagggggtaactacggaggtacgtacgacgtacctaacggtactacgttaacttcgtacgttcggtaccgggg

SEQ ID NO: 101984 - DNA, 589 bp, Homo sapiens
  misc_feature: GYAE6OF01EQ7RN.9.33.C11.1.454.CMB.1.raw
tcagtgatacgtctcacgaccggtgctcgatttagagtgagctcgttgggttttcctcgttgctcttttaagaggtgtccagtgtcaagtgcaactggtggagtcgtggggggggggcgtggtccagcctggggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaaggccgattcacatctccagagacaattccaaagaacacgatgtatctgacaaatggacagcctaagagttagaggacacggctagtttattactgtaacgaaaggagggggatacgagtggacagctacaagtactacttagacttcgcgggtaccacgggtaaccctggtaccaccgtctcctcacgccctaccgacccgtaacgggccccagtcccggtcccttcccccgtgggcccgtccctacgcccgtccgacggacgccctacccgtccgacgtacgaccacgacggcccggcccgtcggg

SEQ ID NO: 101985 - DNA, 530 bp, Homo sapiens
  misc_feature: GYAE6OF01B84UV.9.33.C11.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (291)..(291): a, c, t, g, unknown or other
  misc_feature (291)..(291): n is a, c, g, or t
  modified_base (485)..(485): a, c, t, g, unknown or other
  misc_feature (485)..(485): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
tcagtgatacgtctcacgaccggtgctcgatttagagtgagctcgttgggtttgggggaggaactgctcagttaggacccagagggaaccatggaagccccggagctcagcttctcttcctcctgctactctggctcccagataccaccggagagattgtgttgacacagtctccagccaccctgtctttgtctccaggggaaanagccaccctntcctgcagggccagtcagagtgtaccaccagttagcctggtaccaacacaaacctggccaggctcccaggcccctnatctttgatgcatccatcaggccactggcatcccagccaggttcagtggcagtgggtctgggacagacttcactctcaccatcagcagcctagacgcctagaagtattttgctaagtttattactgtacaacatacgtacgagtcggccgtccgggggcctacgtttccggccctgggaacctaaattgagtanacaaacgactggtcgntgcaccatctgtcttacnctctccgtacc

SEQ ID NO: 101986 - DNA, 804 bp, Homo sapiens
  misc_feature: GYAE6OF01B9TM8.9.33.C11.1.454.CMB.1.raw
  modified_base (216)..(216): a, c, t, g, unknown or other
  misc_feature (216)..(216): n is a, c, g, or t
  modified_base (312)..(312): a, c, t, g, unknown or other
  misc_feature (312)..(312): n is a, c, g, or t
tcagtgatacgtctcacgaccggtgctcgatttagagtgagctcgtttgggtttgggggtagggaacgtgcgtcgagttaggacccagaggggaaccatggaacgccccagcctcgagccttctcttcctccctgctactctggctcccagataccaccggagagacttgtgttgacacagtctccagcccaccctgtctttgtctccaggggaangccacctctcctgcaggccagtcagagtgttaccaccagttacgcctaggtaaccaacaacaaacctggacctacggcctacccgacggcccctanaacttccgtttacgactcggcctacttccagtccgacgggtaccctaacgtcggtactacgtccccgaggtcccgtaagggttccgaacggttggaccgtaggttcgggttccgtcggggaacctacggtacctttccgaccttccgtaccaacccgtaacttaccgaacggtacctaacggtaccctaacggtacgtacccgttaaggtaaacggttacgtttttacggacgttaaggttttaacgttaccgttacgttaacctaaacgttacgttaccggttaaccggtacggttaccgggtcccggttacccgggggtacccttacccggtttacccgggtacccggttaacgggtaacccgttaaaggtttcggtaacgtaacgttaaccgtaaaaccggttaacgttcgggttacgggaccgtacggtaccctaaccgtacgttaccgttacgttacctttacaccgtttccccgttcccgtacccg

SEQ ID NO: 101987 - DNA, 638 bp, Homo sapiens
  misc_feature: GYAE6OF01A1P73.9.33.C11.1.454.CMB.1.raw
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaaagagccaccctctcctgcagggccagtcagagtgttaccaccagttagcctggtaccaacacaaacctggccaggctcccaggcccctnatcttgatgcatccatcgagggccacgtggcatccccagcccaggttccagtggcaggtgggtctgggacagacttcactctcaccatcagcacgcctagacgcctagaagtatttgacgttaagtttacttacttagtacaaactacttaccggtaaccgtacggtcggtccggtcccgggggtacccttaccggtttccgggtaccccgttacggggtaacccgtaaacgttacggaacgtaacgttaaccgaaaaccggtaacgtacggtacgggtaccgttacggacctaacccgtacttccgttacggttacctttaccgtaactttcccgttccccgtacccg

SEQ ID NO: 101988 - DNA, 597 bp, Homo sapiens
  misc_feature: GYAE6OF01EBMOQ.9.33.C11.1.454.CMB.1.raw
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttacgcctggtaccaacacaaacctggccaggctcccaggcccctnattctttgatgcatccatcgagggccacgtggcactcccagccaggttcaggtggcaggtgggtctggggacagacttcactctacaccatcagcagcctagacgcctagaagttattttagacttagtttattactgtacaactagttccgtaacgaggtcgggcccgtcccggggtaccctaccggtttccgggacccgtacgggaacctaaagttcggaacgtaactaccgaaaacgtaacgtggtacggtactaggccaacctattcgttcgttaccttactacttcccgttcccgtaccc

SEQ ID NO: 101989 - DNA, 656 bp, Homo sapiens
  misc_feature: GYAE6OF01DMQKE.9.33.C11.1.454.CMB.1.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattgtgttgacacagtctccagcccacccttgtctttgtctccgaagggggaaagacgcccaccctctcctgcgagggccagtcagagtcgttaccaccagttacgcctggtaaccaacaacaaacctggccaggcctcccaggcccctnatcttgatgcatccatcgacggccacgtggcactcccagcctaggttcaggtggctaggtggtctgggacagcttcactcacaccatcagcagctagacnctagaatatttgactagtttatacgtgtacaaacgtacttaccggtaacggaggttccgggacccgggttccccgggggtacccttacccgggttttcccggggacccccgttaaggggtaaaccctaaaaggtttcggaacgtaacgtaaccgtaaaaaccggtaaccgttgggtacggtaccgtacggaccctaaccgtacgtttccgttacgtttaccttacctaacctttccccgttccccggtaacc

SEQ ID NO: 101990 - DNA, 670 bp, Homo sapiens
  misc_feature: GYAE6OF01EE7F9.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactcttgctcccagataccaccggagagattgtgttgacacagtctccagccaccctgtctttgtctccgaggggaagacgccacctctcctgcagggccagtcagagtcgttaccaccagttacgcctaggtaaccaacacaaacctcggccaggcctcccgacggcccctctacttctttgatcgcactccatcgacgggccacgtggccactcccagccgtaggttcaggtcggcgtaggtcgggtctacggggacagtaccttacgactctaccactactcacgcacgctagacgtcctagtaagttctttagacttaagttttactacttaggtacctaactacgtaccggtacggtacggtccgggtacccggttcccgggggtaccttaccggtttccgggacccgttaacggggtaaaccctaaagttcggaaacgttaacgtaaccgtaaaccggtacgtacggtcggtaccgacggtaccctaacttagttaccgttacggtttaccttacgtactttccccgtacccggtaccc

SEQ ID NO: 101991 - DNA, 626 bp, Homo sapiens
  misc_feature: GYAE6OF01DHCEA.9.33.C11.1.454.CMB.1.raw
  modified_base (202)..(202): a, c, t, g, unknown or other
  misc_feature (202)..(202): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaaangccaccctctcctgcagggccagtcagagtgttaaccacccagttagcctggtaccaacaacaaacctggaccacggcctccccgacggccccctcactctttgatcgcactccatcgacgggccacgtggcactccccagccaggttcaggtggctaggtgggtcgtagggactagacttcactctcactatcagcagcctagacgcctagtaagtattttgacttaagttttacttacttagttactaaactacgttaccggtacgacggttcgggtcccggttacccgggggacccttaccgtttccgggtacccgtacggggtaacctaaagttcgaagtaacgtacgaaacgtacgtaggtcggtactacggccaaccgtacttacgttcgttacttactaccttccgttcccgtaccc

SEQ ID NO: 101992 - DNA, 598 bp, Homo sapiens
  misc_feature: GYAE6OF01AY3PK.9.33.C11.1.454.CMB.1.raw
  modified_base (580)..(580): a, c, t, g, unknown or other
  misc_feature (580)..(580): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaagagccaccctctcctgcagggccagtcagagtgttaccacccagttagcctggtaccaacaccaaacctggccaggctcccgacggcccctcatctttgatgcatccatcagggccacgtggcactcccagccaggttcaggtggccaggtgggtctggggacaggaccttcactcctcaccatcagcacgcctagcgcctagtaacgtagttttgacttagttttaattacttcgtacaactagtaccgtaccgtaggtcggtcccggtcccggggccctaccgtttccgggtcccgttacgggaacctaaacgttcgaacgtacgtacgaaaaccgtacgtaggtcgtactcggccaccgtattccttgtcccttanaccttccgtccccgtacc

SEQ ID NO: 101993 - DNA, 723 bp, Homo sapiens
  misc_feature: GYAE6OF01BUU6L.9.33.C11.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaangccacctctcctgcagggccagtcagagtcgttacccacctagttacgccgtaggtaccaaacaacctaaaccgtcggaccaacggcctaccccgacggtccccctanacttcctttgactcgactactccatcgacgggccctacgtcggacacctccccgaggccgtaggttcaggtcggacgtaggtcggggtcgtacggggaactacggtaccttcctaacgtcctaccgaacctagtaccgacggaccaacgtacccgtaaggaccggtaccgtaaggtaaacgtttagttttacggacctttaagtttttaacttacgtacgttaacctaaacgtacgttaccggtaaccggtacgggtccgggtccccgggtccgggggtacccttaccggtttccgggaccccggttagggtaaaccctaaaggttcgaacgtacgtaaccgtaaacgtacgttggtcggtactcggtacccacctgttccgttcttaccttacctacttcccgtccccgtac

SEQ ID NO: 101994 - DNA, 610 bp, Homo sapiens
  misc_feature: GYAE6OF01CNS6V.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaagacgccaccctctcctgcagggccagtcagtagtgttacccaccagttacgcctaggtaccaacacaaacctggaccaggctcccacggccccctacactctttgatgcatccatcgacggccactggcactcccagccagttcaggtgcaggtggcgtggacagtaccttcactctacaccatcagcacgtcctagagtccgtgaagtagtttgacttaagtttattactgtacaactattccgtaccggagtccggaccggttcccgggctaccgtttaccgggcccgttacgggaaccttaaagttcggaacgtaactaaccaaaaccggtacgtacggtacggtcgtaccgacgtaccctagtccgttcgttaccttacgaactttcccgttccccgtaccg

SEQ ID NO: 101995 - DNA, 698 bp, Homo sapiens
  misc_feature: GYAE6OF01DP7MT.9.33.C11.1.454.CMB.1.raw
  modified_base (683)..(683): a, c, t, g, unknown or other
  misc_feature (683)..(683): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagactaccgaccggagagattgtgttgacacagtctccagccaccctgttctttgtcctccgaaggggaaagacgccaccctctcctgcagggccagtcagagtcgttaccaccctagttacgcctaggtaccaacacaaaccgtggaccaggcctacccgacggcccctcattcttgatcgcactccagtcgacggccagtcggcactcccagccgtaggtcaggtcgcgagggttcggcgtaggggacaggtaccttcacttctaccaacccataccgagaccgtacgaccgtaagaccgtaccgttaggtaaacgttagtttttacgaaccgttaaggtttttactttaacgttacggttaaccaaacgttaacgttaccggttaacccggtaacggttccgggtccccgggttacccgggggtacccctttaaccggtttccccgggtacccggttaacgggtaaacccttaaaagttcggaaacgtacgtaaaccgaaacgtaacgtggtacgacgtgacctaccgattccgtctacttanccttccgtcccgtac

SEQ ID NO: 101996 - DNA, 549 bp, Homo sapiens
  misc_feature: GYAE6OF01AU384.9.33.C11.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttaccaccagttacgcctggtaccaacacaaacctggccaggcctccaggcccctnatctttgatgcatccatcagggccatggcactcccagccaggttcagtggcaggtggtctgggacagtacttcactctcacatcagcacgcctagacgcctagaagtatttgactagtttatactgtacaactatacgtacgagtcggccgtccggggacctacgttccggcccgtagggaacctaaagttcgagactacaaacgtaactggtacgtctacgcacatctcgttacttactacttcccgtcccgtacc

SEQ ID NO: 101997 - DNA, 687 bp, Homo sapiens
  misc_feature: GYAE6OF01C9RNG.9.33.C11.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctccagataccaccggagagattgtgttgacacagtctccagccaccctgtctttgctccgaggggaancgcccacctctcctgcagggccagtcagagtcgttaaccaccagttagccgtaggtaaccaacaacaaacctggaccaggcctcccgacggcccctntactctttgatcgctatccagtcgaggccacgtggccactcccgagccgtaggttacaggtcggcgtaggttggggtctacggggaactaggtaaccttcgaccttacgcctaccgaactcgactacgacgtccgtaagacgtcctaggtaagttcgttttcgacgtttaagtttacgttacgtgttactaacgtcgttacgtaccggtaggttccggtcccgggttccggggtacccttcccggtttacccgggacccgttaacgggtaaaccctaaagttcggaacgtaaccttaccgaaaaccgtacgtcggtacggtcctacggtacctaacccgtagttcccgttacgtttacctcctttaaccgtcccgtttaccccgtacg

SEQ ID NO: 101998 - DNA, 586 bp, Homo sapiens
  misc_feature: GYAE6OF01AZOHB.9.33.C11.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattgtgttgacacagtctccagccacctgtctttgctcgaggggaangccacctntcctgcgaggccagtcagagtcgttaaccacctagttacgccgtaggtaaccaacacaaaccgtggaccaggcctacccaggcccctanacttcttgatgcatccatcgacggccagtcggcactcccagcctaggttcaggtcggcgtaggtgggtctggggacagtacttcgactcacgaccatcagcacgcctagacgccgtagaacgttatttcgacttagtttatactagtacaatctacgtacgagtcggccgtcgggtacctacggttccggacccgtaggaacctaaagtgaacgtactaacgaaacgtacgtcggtcggctacgccacgtacgttcgttcgttaccttacaccttccgttcccgtacg

SEQ ID NO: 101999 - DNA, 546 bp, Homo sapiens
  misc_feature: GYAE6OF01AC76N.9.33.C11.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (533)..(533): a, c, t, g, unknown or other
  misc_feature (533)..(533): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnatctttgatgcatccatcagggccactggcatcccagccaggttcagtggcagtgggtctgggacagacttcactctcaccatcagcagcctagacgcctgaagtattttgacttagttttatactgtacaactatccgtacgagtcggcccgtccggggcctaccgtttccggcccgtacgggaacctaaagttcgaagtatacgaaacgtactggtggctggccacctatctcttcttancttcctcccgtcc

SEQ ID NO: 102000 - DNA, 641 bp, Homo sapiens
  misc_feature: GYAE6OF01C9KDG.9.33.C11.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctaccgagggaanacgcccaccctcncctgcagggccagtcagacgtcgttaccaccctagttacgcctaggtaacccaacaccaaacctggcccaggcctccccacggtcccctctattctttgatgcatccagtccgacggtccacgtcgccatcccagtccaggttcgngtggcgtagtggggtctgggacctagacttcactcctcaccatccacgcctagaccgtagtacggaccttagttaacgtactttttagacttaagttttacttactacgttactaaccgtacgttacggttaccgtacggttccgggccgttccggggtaccctacggtttccgggacccttaagggacctaaagttcggaacgtaactaccgtaaacggacgttcggcgtactcgtacctactcgttccttcgttacttcctacctcgttcccgtacg

SEQ ID NO: 102001 - DNA, 538 bp, Homo sapiens
  misc_feature: GYAE6OF01D59R9.9.33.C11.1.454.CMB.1.raw
  modified_base (291)..(291): a, c, t, g, unknown or other
  misc_feature (291)..(291): n is a, c, g, or t
  modified_base (517)..(517): a, c, t, g, unknown or other
  misc_feature (517)..(517): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatcttgatgcatccatcagggccactggcactcccagccaggttcagtgcagtgggtctgggacaggacttcactctcaccatcagcagcctagacgcctagaagtatttgactagtttacttactgtacaactatacgtacgagtcggccgtccggggtacctacgttccggtcccgtacgggaacctaaagttgagtactacgaaacgtactggtcgctgcacntctctcttcactcgtccgtcc

SEQ ID NO: 102002 - DNA, 545 bp, Homo sapiens
  misc_feature: GYAE6OF01CMZ2Q.9.33.C11.1.454.CMB.1.raw
  modified_base (205)..(205): a, c, t, g, unknown or other
  misc_feature (205)..(205): n is a, c, g, or t
  modified_base (449)..(449): a, c, t, g, unknown or other
  misc_feature (449)..(449): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtctccagccaccctgtctttgtctccagggggaaangccaccctctcctgcagggccagtcagagtcgttaccacccagttacgcctaggtaccaacacaaacctggccaggcctcccaggcccctcatctttgatgcatccatcgacgggccacgtggcactcccagcctaggttcaggtggcgaggtgggtctgggacagtacttcactctcaccatcagcagcctagacgcctagaagtatttgactagtttacttactgtacaactactcgtacgngtcggtccgtccggggcctacgttccggccgtacggaacctaagtgacgtatacgaaacgtatgtcgctagcactntctgtcttnctcctccgtcc

SEQ ID NO: 102003 - DNA, 623 bp, Homo sapiens
  misc_feature: GYAE6OF01C5R9G.9.33.C11.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (387)..(387): a, c, t, g, unknown or other
  misc_feature (387)..(387): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctcagccaccctgtctttgtctccgaggggaaacncgccacctctccngcagggccagtcagagtcgttaccaccctagttacgcctaggtaccaacaaccaaacctggccaaggcctccccgacggcccctcatctttgatgcatccatcgacgggccacgtcggcactcccagcctaggttcagtggcaggttgggctgggacagtacttcactcnctacatcacgcacgaccgtaacgacgaccgtagaaagttattttagacttaagtttactttactgtacaaacgtcgttaccgtacggtacgtccgggccggtcccggggtacctacggtttccggacccggtacgggtaacctaaagttacggaacgtaacgtaccgaaacgtacgtacggtcggctacgaccaccgtatcgttcgttactttactacgttcccttccccgtaccg

SEQ ID NO: 102004 - DNA, 761 bp, Homo sapiens
  misc_feature: GYAE6OF01CYBHQ.9.33.C11.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtctccagccaccctgtctttgtctccgaggggaaanacgccaccctctcctgcagggccagtcagagtcgttaccacctagttacgcctggtaccaacacaaaccgtggccaggcctcccgacggtcccctacacttctttgactcgcactccaatccgacgggccacgtggacactcccagcctaggttcaggtcggacctaggttcgggtcgtaggggactacgtacctttccgaaccttccgtaccaacctagtccgaacgccgtaacgtacccttaacggacggtacccgttaaggtaaacgttacgtttttacggaccgtttaaaggttttactttaaccgtacgttaaccgtaaactacgttacccggttaaccgtacgggttccgggtccccggttacccgggggtacccctttaccggttttccccggggacccggttaacggggtaaacccttaaaaggtttcggaaacgttaacgtaacccgtaaaaacggtaccgttacgggtccggtaccgttacggaccctaacccgttaagttccgttacgtttccctttaccgtacccttcccgtttccccgtaccg

SEQ ID NO: 102005 - DNA, 547 bp, Homo sapiens
  misc_feature: GYAE6OF01CL029.9.33.C11.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgctccaggggaaangccaccctctcctgcagggccagtcagagtgttaccaccagttacgcctggtaccaacacaaacctggccaggcctcccaggcccctcatctttgatgcactccatcgagggcccactcggcactcccagcctaggttcaggtggctaggtgggtctggggacagtacttcacttcncaccatcagcagcctagacgcctagaacgtatttgactagtttattactgtacaactactcgtacgngtcggccgtccggggcctacgttccggaccgtggaacctaagtgagatacgaacgacgtggtcgtctcgcaccatcgtcgttcttcacttcctcccgtac

SEQ ID NO: 102006 - DNA, 601 bp, Homo sapiens
  misc_feature: GYAE6OF01AD32G.9.33.C11.1.454.CMB.1.raw
tcagtgatacgtctcacgaccggtgctcgatttagagtgagctcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccgccgaggcctccgagggcaaggggtcttgggagtggctggctaggtttgtttcatcgtaggaaggtaagttgttacaaatactatacagacctccggtagaacgggcctattccacctatcctccgaagacgaacctaacttccaaagaaccacgtatagtatctagacaagtgacagacctaaggagttagaggacgacggtcttagtttattacgtagtaacggaagggaggggtatacgagtggacgacgactacgtaagttaccttacgttacgtacgttcggcggggtccgacgggtaaccctcggtacctaccgttcctccctcgcgtccccg

SEQ ID NO: 102007 - DNA, 590 bp, Homo sapiens
  misc_feature: GYAE6OF01DLP9P.9.33.C11.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctccaggggaangccaccctctcctgcagggccagtcagagtcgttaccaccagttagcctaggtaccaacacaaacctggccaggcctcccaggcccctnatctttgatgcatccatcaggccactggcatcccagccaggtcagtgcaggtcggtctgggacagtacttcactctcaccatcagcagcctagacgacctagaagtattttgacttaagtttacttactgttacaactattaccgtacgacggtcgggtcccggttacccgggggcccttaaccgtttccgggacccgttacgggaacctaaagttcgaacgtaactacgaaaacgtacgtggtacggactcggaccaccgtattccgttcgttaccttactacttccgttccccgtacc

SEQ ID NO: 102008 - DNA, 808 bp, Homo sapiens
  misc_feature: GYAE6OF01DD8L9.9.33.C11.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctcgaggggaaancgccaccctntcctgcagggccagtcagagtcgtaccaccagttacgcctggtaaccaacacaaaccgtcggaccacggccctacccgacggtcccctctacttccttttaggaacttcggactaactcctaacgtccggaacggggccctaacgtcgggaccaccgtaccccgaaggtccccgtaagggtttccgaagggttcggaccggtaaggtttcggggtcgttacgggggactaacgggtaacctttcgaaccttcgtaccctaacctactacgaaacggtccaacggtaccgtaacggtacgtaccggttaggtaagttaagtttttacggacgtttaacggttttaactttaacgttagtaacctaaacgtaacgtttaccggtaacccggtaggttaccgggtacccgggtacccgggggtaccctttaacccgggtttcccgggtaaccccgggttaaccggggtaaacccgttaaaacggttcggtaaaaggaacgttaaacccgaaaaccggtaaaccgtcggtaccggtacgtacggaccgtaacctacgttcgttaccgtttacctaccttacttccccgttcccggaaccc

SEQ ID NO: 102009 - DNA, 902 bp, Homo sapiens
  misc_feature: GYAE6OF01BHW9X.9.33.C11.1.454.CMB.1.raw
  modified_base (171)..(171): a, c, t, g, unknown or other
  misc_feature (171)..(171): n is a, c, g, or t
tcagtgatacgtctcacgaccggtgctcgatttagagtgagctcggtgggagaggagcccagcactagaagtcggcggtgttccattcggtgatcagcactgaacacagaggacctcaccatggaggtttggctgagcgttgggttttcctcgttgcttctttaagaggtntccagtgtcaagtgcaacgtggtggagtcggtgggggggctggtccagccgtgggacggtccctaggacgtacctcgtccgtggtcgcgtaggtcttacgtggtacttaccgtaaccgttacgaaacggttaaccgtacgggtcgttacgaccgtaaccggttccggggtaccccgaccgaacgggtcccttaccggaaacggggtacccggtaaagggggttcccgtttagggggaacgggttccgggtccggttacggggtaccgtttaacgggtttggttttaaccccagttaccggttaagggtaaaggggttaacgtttcggttaaacctaaaacgttaccgttaaacgttaacccgaaacgggtacccgttaccgggtaaggtaaaccgggtccgttaactacccgtaaccgttactaccgtaccggaagtaaccgtaacctaaacgttacccggaaataaccgtaacgtaattacgtacgttactaacgtaactaaacggtggaacctacgggtaaccgtaagggtaacggttacggaacgggttaaccgtaccgggttacgtttacggttaacgttaaccgggtaaggtaaaaccggggtaaacggggtaaggggtaaccgtaaccggtaagggtacccgggtacgtaaccggttacgtaaccccggttaaacgttaccgttttaaccggttacgttacccgggttcccggtaacccgggggg

SEQ ID NO: 102010 - DNA, 625 bp, Homo sapiens
  misc_feature: GYAE6OF01DFEJS.9.33.C11.1.454.CMB.1.raw
  modified_base (438)..(438): a, c, t, g, unknown or other
  misc_feature (438)..(438): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtcctccagccaccctgttctttgtctccgaaggggaaagcgcccaccctctcctgcagggccagtcagagtcgttaccaccagttacgcctaggtaaccaacaacaaaccgtggaccaggcctacccgacggcccctcatctttgatcgcactccatcgacgggcccacgtggccactcccagccgtaggttcaggtcgcgtaggtcgggtcgtagggactagtacttcactctacaccatcagcagacctagacgtcctagtaagttnttttgacttaagtttacttacgtagtactaactagttaccgtacgtaggtccgggtccgtccggggtcctaccggtttccggaccgtacgggaacctaaagttcgaacgtaacgtaacgaaacgtacgtcggtacgactagcccaacctagttcgtcgttaccttcgtaccttcccgtcccgtaccg

SEQ ID NO: 102011 - DNA, 549 bp, Homo sapiens
  misc_feature: GYAE6OF01DW81J.9.33.C11.1.454.CMB.1.raw
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttccaaaaaacccngttagcctggtaccaacacaaacctggccaggctcccaggcccctnatcttgatgcatccatcagggccactggcatcccagccaggttcagtggcagtgggtctgggacagacttcactctcaccatcagcagcctagacgcctgaagtattttgactagtttattactgtcaactatccgtacgagtcggccgtccggggcctacgtttccgggcccgttagggacctaaagttgaagtactacaaacgacgtaggtcgactggccacctatctgtacttcacttccgttcccgtacc

SEQ ID NO: 102012 - DNA, 599 bp, Homo sapiens
  misc_feature: GYAE6OF01CU1BL.9.33.C11.1.454.CMB.1.raw
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (512)..(512): a, c, t, g, unknown or other
  misc_feature (512)..(512): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctcccgtcccccttgcagtaacaccaagtacaggaatattaacctgttccatcgactacgcctttcggcctcgccttagggtcactcaccctgccccgattaacgtggacaggacccttggcttccggngagcggtcttttcacccgntttatcgttacttatgtcagcattcgcacttctgatcctcagcatgcctcacagccactaccttcaacaggtccttaacacgaaccgcccttaccccctaacccaacaacgcaactaacgcgtaccgctcgccgcncgtccgttcggtcgctagttcggtttaccgtccccgtttctaaccttcccgttccccgcctacttcctagtaacgtacgtactaccg

SEQ ID NO: 102013 - DNA, 875 bp, Homo sapiens
  misc_feature: GYAE6OF01BYO0X.9.33.C11.1.454.CMB.1.raw
  modified_base (214)..(214): a, c, t, g, unknown or other
  misc_feature (214)..(214): n is a, c, g, or t
  modified_base (331)..(331): a, c, t, g, unknown or other
  misc_feature (331)..(331): n is a, c, g, or t
tcagtgatacgtctcacgaccggtgctcgatttagagtgagctcgttgggtttgtgggaggaactgctcagttaggacccagagggaaccatggaacgccccagctcagcttctcttcctcctgctactctggcctcccagactaccaccggagagattgtgttgacacagtcctccacgcccaccctgttctttgcctaccgaaggggaaacncgcccacctctcctgccgacgggtccaggtcaagagttacgtaacccacctaggttacgccgtacggtaacccaacaaccaaaccgtcggccaacggcctacccgacggtcccctanactttcctttgagttcgactaactcctactaccggacggacccacgtcgaccaactcccgaacgtccgtaaggtcctaaggccggataggtgggtcgagggacctacggtcctacgaccttccacgacctaagtccaagtaccgacgaccgtagaccgtacctaggtaacgttacgttttacgacgttttaagtttactttacccgtagttaacctaaccgtacggtttacccggtaacggtaccgggttacccgggtacccgggtttacccccgggggaccctttaaccggggttttaccccccggggaaccccggtttaaaccggggaacccctttaaaaacggttaccggggtaaaaacgtttaacccggttaaaaaccgggtaaaacccgggttaaacccggttttacgggtaccccgggggttaaaccctttacccgggaaccccgtttaaacccccgtaacgtttttacccgttttaaccggtttacccggtttttaaccccttaaacccggtttttcccccccgttaaacccccggg

SEQ ID NO: 102014 - DNA, 649 bp, Homo sapiens
  misc_feature: GYAE6OF01DOPIU.9.33.C11.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccacctctcctgcgagggccagtcagagtcgttaccaccgtagttacgcctaggtaccaacaacaaaccgtcggaccacggcctcccgacggcccctnacttctttgactcgctactccatccgacgggccacgtggacactcccagccgaggttcaggtggcgtaggtcggggtcgtagggactaggtacttcacctctaccaccatcacgacacgacctagacgccgtagtaagttattttgacttagttttaacttactcgtacaacgtacgttaccgtaacggtaggtcgggtcccggttacccgggggccttaccggtttcccgggacccggttacgggaaccctaaagttcgaacgtactaaccgaaaacggtaacgtcggtacggactacgccaccgtacttccgttcttacttacctactttcccgtcccgtacc

SEQ ID NO: 102015 - DNA, 628 bp, Homo sapiens
  misc_feature: GYAE6OF01C2513.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctccgaaggggaaagcgccaccctctcctgcagggccagtcagagtgttaccacctagttacgcctggtaaccaacacaaacctcggccaggcctccgacggcccctcacttctttgactgcactccatcgacggccacgtcggctactcccagcccgtaggttacaggtcggcgaggtcgggtacgtggggacacgtacttcgactctcgacctatcagcacgtcctaagacgtcctagaagtattttgacttaagttttatacttgtactaactacgttaccgtaccggtaggtccggtcccggtacccggggaccttaccggtttccgggacccgttaacgggtaaccgtaaagttggaacgtaacgtaccgaaaacggtacgtacggtacggtctacgcacctatctcgttacttactacttccgttcccgtacg

SEQ ID NO: 102016 - DNA, 636 bp, Homo sapiens
  misc_feature: GYAE6OF01C8U7X.9.33.C11.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaaggggaaanacgcccaccctctcctgcagggccagtcagagtgttacccaccagttagcctaggtaaccaaacacaaacctgggaccaggtcctacccaggccccctnattcttgatgctatccatcgacggccagtcggcactcccagccaggttcagtggcaggtggtctagggacagtacttcactcctacaccatccagccagcctagacgtcctagtaacgtattttcgactaagtttatactgtaccgaactacgttaccgtaacggtagttaccgggcccgtccgggggtaccctaccggtttcccgggtacccggtaacgggtaaaccctaaaacgttggaaacgtaacgttaaccgaaaacggtaacgtggtacggcttacggctaacccgtattccttcggttacttacgtccttcccgtccccgtaaccg

SEQ ID NO: 102017 - DNA, 656 bp, Homo sapiens
  misc_feature: GYAE6OF01A13ZG.9.33.C11.1.454.CMB.1.raw
  modified_base (210)..(210): a, c, t, g, unknown or other
  misc_feature (210)..(210): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (469)..(469): a, c, t, g, unknown or other
  misc_feature (469)..(469): n is a, c, g, or t
tcagtgatacgtctcacgaccggtgctcgatttagagtgagctcggttgggtttgggggaggaactgcgtcagttaaggacccagagggaaccatggaagccccagctcagcttctcttcctcctgctactctggcctcccagatacccaccggagagattggtgttgacacacgtctccagccaccctgtcctttgctccaggggaaangcccacctctcctgcagggccagtcagacgtcgttaccacccagttacgcctcggtaaccaacaccaaaccctggcccaggcctcccgaccggcccctcattctttgactcgcactccgatcgacggggccaccgtggaccactcccgagccgtaggtcaggtggcaggtggtcgagggacncgtactccactctacactancacgcacgtcgtagactccgtagtaagttcgtttacgacgttaattttactacgttntaacgtactacgttaccgtacggtacgtccgggtcccgggtcccgggtacccttacggtttcccggacccggtaacggtaaaccgtaacgttgaacgtaacgtaccgaaacgtacgttcggtccggacttacgccaacccgttgtacccgttcttcccgttatacccgtttcccgttcccgtaaccg

SEQ ID NO: 102018 - DNA, 653 bp, Homo sapiens
  misc_feature: GYAE6OF01BXUO8.9.33.C11.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (434)..(434): a, c, t, g, unknown or other
  misc_feature (434)..(434): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgttctttgctccgaagggggaaangcccaccctctcctgcagggccagtcagagtcgttacccaccagttagcctggtaccaaacacaaacctggccaggcctcccacggcccctnactctttgatgcatccatcgacgggccacgtcggacactccccagccgtaggttcaggtcggacgtaggtggggtctaggggactagccttacactcctacaccatcgagcacgccgtagacgtctagtaacgttntttcgacttagtttacttactacgttacaacgtactccgtaaccgtaggtccggtcccggtcccggggtaccctaccgtttcccggtaccccggtacgggtaaaccttaaagttacggaacgacgtaaccgaaaacgtaaccgttggtacggtacctacggtcccaacccgtgttaccgttaccgttcctttaccgtacttccccgttcccgtaacccg

SEQ ID NO: 102019 - DNA, 719 bp, Homo sapiens
  misc_feature: GYAE6OF01AF056.9.33.C11.1.454.CMB.1.raw
  modified_base (187)..(187): a, c, t, g, unknown or other
  misc_feature (187)..(187): n is a, c, g, or t
  modified_base (436)..(436): a, c, t, g, unknown or other
  misc_feature (436)..(436): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagtccttgtacttttccggatttcgacctaggaaaaaccngccctacccgacttaaaaccgggacaaccgtccgcccggaccaacatacgccttcctcccgtccccccttgcacgtaacaccaagtacagtaattacttaacctcgtttcccatccgactaccgtcctttcggcctcggtccgttaggggtccacctccaccctcgaccccgtaagttaaccggttcggaccacggtaaccctttggtccttccggcgtacggtccgggttccttttccgaccccgttnttttactccgtttaactagtcgtcacgctacttcgctacttcagacttcccgtccagtctacgtcgcctaccacacgccaaccctaccttacgacgtacgtccttaacaacggtaaccctccctaaccccctaacccaacaaccgacaacgtaaccgcgtaccgtctccgccgtacgacgtcgttcggtcgtacgttacgttccggtttacccgtccccgtttactacccgttccccgttacccgaccgtaacgttaccgtaggtaaccgtccgtactaccgg

SEQ ID NO: 102020 - DNA, 636 bp, Homo sapiens
  misc_feature: GYAE6OF01BLRES.9.33.C11.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattgtgttgacacagtctccagcccaccctgtctttgctccgaggggaaagngcccaccctctccngcagggccagtcagagtcgttacccacccgagttacgcccttagggtaaccccaaactaaccaaaaccctgggacccagggccctccccagggccccctcacttctttggactgcatccatcgacggggcccacgtcggcactccccgaagtccaggttcaggtcgcgtaggtgggtcgtagggacagtactcacctctcaccatccagcacgcctagacgtcctagagttatttcgacttaagttttacttacttcgtacaacgtagttaccggtaccgtggtacggtcccgggtccggggtaccctacggtttcccgggcccgttagggaacctaagttacgataccgtacaaaacgtacgtaggtcgtactgccacctgttcctcgttcttactaccttcccgtcccgtaccg

SEQ ID NO: 102021 - DNA, 519 bp, Homo sapiens
  misc_feature: GYAE6OF01ECLH5.9.33.C11.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctntcctgcagggccagtcagagtgttaccacccagttagcctggtaccaacacaaacctggccaggctcccagcccctcatcttgatgcatccatcagggccactggcatcccagccaggttcagtggcagtggtctgggacagacttcactctcaccatcagcagcctagacgcctgaagtatttgctagtttattactgtcaacatcgtaacgagtggcctccggggccacgttccggtccctgggaccaaattgagatacaaacgaactgtgtctagcaccatctgtactctactcttcccgtcc

SEQ ID NO: 102022 - DNA, 965 bp, Homo sapiens
  misc_feature: GYAE6OF01DHEFA.9.33.C11.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
tcagtgatacgtctcacgaccggtgctcgatttagagtgagctcgttgggtttgggggaggaactgctcagttaggacccagagggaaccatggaacgccccagctcagcttctcttcctcctgctactctggctccagataccacggagagtattgtgttgacacagtctccagccctaccctgttctttgtcctcgaagggaaancgccaccctntccngcgaggccagtcagacgttcgtaccacctagttacgccgtacggtaaccaaaccacgtaaaccgtcggaccaacgggcctaccccgaacggcccccttacgtaactttcgttttacgacgttacgacctaacttacccgtaacgttaccggaacggggtacccctaaccggtcgggtacctaaccgttaccccaacgggtacccgttaacgggtttacgaacgggtcgggaccggttaacgggtttcgggtaccgggttacggggaacgtaacggtaccttaccggtacctttaccctaccctaaaccctaacgtaccgtaaccggtaccgttaaaccggacccggttaacggtaaccgtaacccgggtttaaggttaaaacggttttacggttttttaccggtaaaccgttttaagggtttttttaaactttaccgggtttaaacgttaaaccgtaaaccgttaacggtttacccgggttaaacccgggttcggggttaacccggggttccccgggggttacccccggggtaccccgtttaaccgggttttaccccgggggaccccggtttaaaccggggaaaacctttaaaaccggttcggtaaacgttaaccgtaaaccggaaaaccggttaaccgttaccggggttcgtacgttaaccggacccttaaacccggttacgttacccggttaccgtttcctttaaccggttacccctttcccgttaccccggtttaaacccg

SEQ ID NO: 102023 - DNA, 609 bp, Homo sapiens
  misc_feature: GYAE6OF01A6KBA.9.33.C11.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (566)..(566): a, c, t, g, unknown or other
  misc_feature (566)..(566): n is a, c, g, or t
tcagtgatacgtctcacgaccggtgctcgatttagagtgagctcgtgggagaggagcccagcactagaagtcggcggtgtttccattcggtgatcagcactgaacacagaggactcaccatggagtttgggctggagcgtggtttcgtcgtaggcgtcttaagaggtgtcagtgcaagtgacatggtggagtcgtggggggctggccngcgtgggagtcccgtgagactctcctgtcgcaggctcnggtctcaccttcagtactacggcgtncgtacgnggtccgcgnggctccgaggccgtaaggtcgttggagnggtccgtggtgtagtttgttaccngttacgaggtaaaggtagttgttaanaacttactaattacacgttacgccggtagaaacgggtccattccaactntcgtaccaggtaanacaacttaccgaaacaacgacgtagacgttaactcgtacagtaagacgaacgtaagactaacggtattaggacgtacgtaagtgttaagttacgtagttacggaaaggtacggtaggggactacggtaagtcggganacgtaccctaagacgttactaacgtttcgacgtttcggacggg

SEQ ID NO: 102024 - DNA, 587 bp, Homo sapiens
  misc_feature: GYAE6OF01A7P9O.9.33.C11.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccagggggaaangccaccctctcctgcagggccagtcagagtcgtaccaccagttacgcctggtaccaacacaaacctggccaggcctcccgaggcccctnatctttgatgcatccatcacgggccacgtggcactccccagccgagttcagtggcaggtcgggtctcgggacacgtacttcactctacaccatcagcagtctagagctagaagtatttcgacttagtttattactagtacaactactacgtaccgtgtcgggtccgtaccggggcctacgtttcgggcccgtacgggtaacctaaagttgaagtactacgaaaccgtatcggtacggtcacggtaccacccgtattccgttcgttaccttaccgtacttcccgttccccggtacc

SEQ ID NO: 102025 - DNA, 780 bp, Homo sapiens
  misc_feature: GYAE6OF01CUSH3.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccacgccaccctgtctttgtctccgaggggaaagcgccaccctctcctgcagggccagtcagtgtcgtaccacccagttacgcctaggtaccaacacaaaccgtcggaccaacggcctacccgacggcccctacacttcctttgatcgactactccgatcgacgggcccacgtcggacacgtccccacggaccgtaggtccgaaggtcggaccgttaggtcggggttccgtagggggaacctacggtacctttacgacctttccacgtaaccctaatccgacggtaccacgtacccgttaaggcgtaccgttaagtaaagttactttttagtacgtttaaacgttttacgttaccgttacgttaaccgtaaacttaccgttaccgggttaaccggtacgggtttacccgggacccgggtttacccggggggtaccctttacccggtttacccggggtacccggttaacggggttaaaccttaaaacggttaggtaaacgtacgttaaccgaaaacggttaccgttaacgggtcggtaccgtacgtaccctaacccgtaacgttcgttaccggttacctttccggtaacccttccgttacccccggttac

SEQ ID NO: 102026 - DNA, 742 bp, Homo sapiens
  misc_feature: GYAE6OF01CWH21.9.33.C11.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (286)..(286): a, c, t, g, unknown or other
  misc_feature (286)..(286): n is a, c, g, or t
tcagtgatacgtctcacgaccggtgctcgatttagagtgagctcgttgggtttgggggaggaactgctcagttaggacccagagggaaccatggaagccccagcttagcttctcttcctctgctactctggctcccagataccaccggagagattggtgttgacacagtctccagccacctgtcttgctccgaggggaangccacctcncctgcaggcagtcagagtctaccaccagttacncctaggaaccaanacaaacctggccaggcctcccgaggcccctnattcttgatcgctactaccatccgacggcctacgtcggactacttcccgagccgtagggttcaaggtcgctaggttcggtacagggacacgtacctttcaccttcgtaccacgtacacgaacgtctaacgtacccgttaaggaccgtaccgtaagtaaacgttagtttaggtaccttaaggttttaacttacgtacgttaaccgtaaacgttaccgttaccggtaaccggtacggttccgggtaccccggttccccgggggtaccttaacccgggttttcccgggaccccgtttaacggggaaacccttaaaagtttcgggaaccgtaacgttaaaccggtaaaacccgtaacggttacgggttacggaccgtacggtaaccctaacccggttaacgttccgtttaccgttacccgtttaccctaccgtttccccgtttacccgccgttaaaccgg

SEQ ID NO: 102027 - DNA, 808 bp, Homo sapiens
  misc_feature: GYAE6OF01CNFSZ.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtccctccgacgccctacccgttgttcttttcgtcctaccggaagggggaaaacgccgcccctaccccttcgtcctcggccgacgggccagtcgaggtacgttcgttaacccaccgtaggttacgccgtacggaaccaaaccaaccaaaccgtcggaccgacggcctacccgacggtccccctctacttcgtttagatcgactactccagtccgacgggaccctacggtcgacctaccgtaccccgacgtaccgtacggttccgaggtcggaccgtagggttcggggttacggtacgggaactacggtaccctttaccaccgttaccctaccgtaacctaacgtccgaaccgtaccgaccgtaccgtaacggtaccgtacccgttaagtaacgtttacgttttacgtactttaacgtttactttaccgttacgttaacctaacgttacgttacccggtaaccgttacgggtcccgggtacccggttacccgggggtacccttaccggtttccccggtaccggttaccggaaacgttaacggtacgaacgtaccgtaacgaaaccgtacgttacggcgtacgtaccgtacccaaccgttacttccgttcttaccttaccttacccgttccgtccccgtacg

SEQ ID NO: 102028 - DNA, 621 bp, Homo sapiens
  misc_feature: GYAE6OF01E09UM.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggcctcccacggcccctcattctttgatgcatccatcgacgggccacgtggccactccccagcctaggttcaggtggctaggtgggtctgggacagtacttcactctacaccatcagcacgcctagacgccgtaggtattattttcgacttagttttacttactgtactaactattaccggtacgtaggtcggcccggtccggggtacctaccgtttccgggtaccccgttacgggaaacctaaagttacggaacgtaacgttaaccgaaaaccgtaacgttacggtacggtacgtacgacctaccgtagttccgttcgttcttacctaccttcccgtccccgtacc

SEQ ID NO: 102029 - DNA, 606 bp, Homo sapiens
  misc_feature: GYAE6OF01EN6NY.9.33.C11.1.454.CMB.1.raw
  modified_base (557)..(557): a, c, t, g, unknown or other
  misc_feature (557)..(557): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaagagccacctctcctgcagggccagtcagagtgttaccacccagttacgcctaggtaaccaacacaaacctggccaggcctcccacggcccctcatctttgatgcatccatcgacgggccacgtggcactcccagccaggttcagtcggcaggtcgggtcgtgggacagtcttcactctacacctatcagcagcctagacgcctagaacgttatttgacttaagttttattacttgtacctaactagttaccgtacggtacggtcgggtccggtcccggggtccctaccggtttcccgggtacccgtagggaaccctaaagttcggaagactaacgaaaaccgtacgtcgtcggtntacgccaaccgtattcgttacgttcttaccgtaccttccgtcccgtacc

SEQ ID NO: 102030 - DNA, 955 bp, Homo sapiens
  misc_feature: GYAE6OF01AQ81Q.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagactaccaccggagagattgtgttgacacagtctccagccacctgtctttgctccgaaggggaaancgcctacctctcctgcgacgggccagtcagagttcgtaccaccgtagttacgccgtaggtaaccaaacaaccaaaccgtcggaccgaacggtccctacccgaccggtcccctactacgtttcgttttaggacttcggacctaacctacccgaacgttaccggaaccggggtaccctaacggttcgggaccctaaccgttaccccgacggtacccgttaacgggtttaccgaacgggttcgggaccgtaaggggttccgggggttaaccggtacgggggtaaccgtaacggttaacccgtttaccgtaacccgttaccgtaacccgtaaacccgtacgtaccgaacgggtaccctaaccgggtaacccgtaagggtaacccggtaccgttaagggttaaacgtttacgttttaacgtaaccgttttaaagtttttaaccttaacgttacgtttaaacaaaccgttaaccggttacccggttaaccggtaacgggttcccggggttaccccgggttcccggggtaaccgtttaccccgggtttacccgggtaaccccgggttaacggggtaaaaccttaaaacgggtttacggaaacggttaaaccgttaaacccggtaaaaaccgggttcgttaacggggttcccggtaacggttaccggtaaaccccgttaaaccgttaccgtttaccgtttaacccggtttacccttaaccccggtttaacccttttacccccggttaccccggttaacc

SEQ ID NO: 102031 - DNA, 816 bp, Homo sapiens
  misc_feature: GYAE6OF01C1GZB.9.33.C11.1.454.CMB.1.raw
  modified_base (205)..(205): a, c, t, g, unknown or other
  misc_feature (205)..(205): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctaccgaggggaaancgccaccctctcctgcagggccagtcagtagtcgttaaccaccagttacgcctaggtaccaacacaaacctggccaggctcccacggccctcatctttagatcgacactccatcgacgggcccacgtcggactacgtccccaaggcccgtaacggttcaagggtcgggtaccgtagggttcggggtcgttaggggaaccgtaagtaaccctttcgaacctttcccgacctaaccgaacttaccgacgaccaacgtacccttaaggaccgtaccccgttaaggtaaacgtttacgttttttacgaaccgtttaagtttttaaccttacgttacgtaaccgtaaaccttaacggttacccgggtttaaaccggacggtttaccggggtccccgggtttaacccccggggggtacccgtttacccggtttttaccccggggaccccgtttaacgggggtaaacccctaaaaaggtttcgggaaaccggtaaacttaaaccggtaaaaccgtaccggtttacggtacggtacccgttacgtacccgtaacccgttaacttccggtttaacgttacccttttactaacccgttccccgttttaccccggtaacccg

SEQ ID NO: 102032 - DNA, 575 bp, Homo sapiens
  misc_feature: GYAE6OF01D2ESA.9.33.C11.1.454.CMB.1.raw
  modified_base (203)..(203): a, c, t, g, unknown or other
  misc_feature (203)..(203): n is a, c, g, or t
  modified_base (551)..(551): a, c, t, g, unknown or other
  misc_feature (551)..(551): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagcccaccctctcctgcagggccagtcagagtcgttaccacccagttagcctggtaccaacacaaacctggccaggcctcccgacggcccctcactctttgatcgcatccatcgacgggccacgtggcactcccagccgtaggttcagtcggcgtaggtgggtcgtgggacagtaccttcactctccaccatcagcacgcctagacgcctagaacgttattttgacttagtttattacgtagtacaactacgtacgtaacgtgtcggtccgtcccggggtcctacgtttccgggtcccgtacggaacctaaagtgaagactaacgaaacgtacgtggtgctgccactntctcgtctctacttccgtccgtac

SEQ ID NO: 102033 - DNA, 726 bp, Homo sapiens
  misc_feature: GYAE6OF01D2K5G.9.33.C11.1.454.CMB.1.raw
  modified_base (334)..(334): a, c, t, g, unknown or other
  misc_feature (334)..(334): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagtattgtgttgacacagtcctccacgcccaccctgttctttgtcctaccggaaggggaaagacgcccaccctctcctgacgacgggccaggtcagtagttacgttacccaccgtagttacgccgtacggtaacccaacaaccaaaccgtcggacccgacgggccctacccgacggccccctnacttcctttgactcgcactcctacgtccggacgggcctacgtggacctacctcccgacgccgtaggttcaggtcggacgtagggtcgggtcgtggggacacgtacctttccgacttcctaccgacctacgtacgacggccaacgtaccgtaaggaccgtacccgttaggtaaacgttactttttcggaacgtttaagttttaacttacttacgtaaccaacttacgttaaccgtaccggtagggtccgggtcccggtaccggggtaccttaccggtttcccgggaccgttaacgggaaccttaaagtcggaacgtactaaccgtaaacgtacgttcggacggtctacgcctacgtattccgttagttaccttacgtccttcccgtcctaccg

SEQ ID NO: 102034 - DNA, 695 bp, Homo sapiens
  misc_feature: GYAE6OF01C1TQE.9.33.C11.1.454.CMB.1.raw
  modified_base (664)..(664): a, c, t, g, unknown or other
  misc_feature (664)..(664): n is a, c, g, or t
tcagtgatacgtctcacgaccggtgctcgatttagagtgagctcggtttggggtttgggggaggaactgctcagttaggacccagagggaaccatggaagccccagctcagcttctcttcctcctgctactctggcctcccagactaccgaccggagagtattgtgttgacacagtcctccacgcccacccttgttctttcgtcctaccggaagggggaaacgacgcccaccctctcctgcgacgggccagtcagtacgttcgttacccaccgtagttacgccgtacggtaaccaaccaacaaaccgtcggaccacggcctaccccgaccggtcccctacgtacttcgtttacgactcgactactccacgtcgaccgggccaacgtcggaccaccgtcccaggaccgtaggttacgacgggtcggtcgtaggttcgggtcgtagggacctacgtacctctacctctaccaactactcgacgacacggtaccgtagaccgtacgtagtaagttacttttcgactttaagttttctacgtacgtactaactacggtaccgtacggacggtccggtcccgggtccgggtaccttacggttacccgggacgtacggaaacttaaggtcgaacgtacgtaaacgacgtagtcggtacgctacgcacttntcgttcgttactcgtaccttccgtcccgtcg

SEQ ID NO: 102035 - DNA, 581 bp, Homo sapiens
  misc_feature: GYAE6OF01ETZS7.9.33.C11.1.454.CMB.1.raw
  modified_base (206)..(206): a, c, t, g, unknown or other
  misc_feature (206)..(206): n is a, c, g, or t
  modified_base (374)..(374): a, c, t, g, unknown or other
  misc_feature (374)..(374): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccgggagagattgtgttgacacagtctccagcccaccctgtctttgtctccgaggggaaangcccaccctctcctgcagggccagtcagagttcgttacccacccgagttacgccctaggtaacccaaacaccaaacctggccaggcctcccaggcccctcattcctttgatgcatccatcgaggccactggcatcccagccaggttcagtcgcaggtggtctgggacngacttcactctcacctatccagcagcctagacgcctagaagtatttgacttagtttaattactagtactaactacgttaccgtacgaggtcggaccgtcccggggacctaccgtttcggcccgtagggaacctaaagtcgaagactacaaaccgtacgtgtacgactcggacacgatacgttcttaccttacncttcccncccgtac

SEQ ID NO: 102036 - DNA, 688 bp, Homo sapiens
  misc_feature: GYAE6OF01DAL2R.9.33.C11.1.454.CMB.1.raw
  modified_base (185)..(185): a, c, t, g, unknown or other
  misc_feature (185)..(185): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
  modified_base (565)..(565): a, c, t, g, unknown or other
  misc_feature (565)..(565): n is a, c, g, or t
tcagtgatacgtctcacgaccggtgctcgatttagagtgagctcgtgggagaggagcccagcactagaagtcggcggtgtttccattcggtgatcagcactgaacacagaggactcaccatggaggtttgggctgagctgggttttcctcgttgctacttttaagaggtcgtccagtgtcaagtncaactggtggagtcggtgggggggctggtccagcccgtgggacggtccctgagtactctcctggtcgcgaggcctcgtggtactttccaccctttacgaacgttaaccgtaccgggcgttcgaccgtacgtcggggtccccgccgacgggtcctacccgagggcgaaggggtcttgggaacggtggcctgggctagtttcgtttcagttcgaggaacggtagttgttaacaaattactaanacacgctacggtagaacgggtcctagttccaacnctccaacagtaacaactaaacttacccgaaagaacaacgtaattgtaactcgtagactaaagtcggaaccaagtccgtaaagtggtacgaaggtacgtaacggtntttaacggttttatacggtagggtaaacggaaacggggaggggtaactaacgtagggttcggaacgacgtaacgtaaccgtaagtttaacccttggttttaacggccttggggtaacccgggg

SEQ ID NO: 102037 - DNA, 821 bp, Homo sapiens
  misc_feature: GYAE6OF01BL40M.9.33.C11.1.454.CMB.1.raw
  modified_base (210)..(210): a, c, t, g, unknown or other
  misc_feature (210)..(210): n is a, c, g, or t
tcagtgatacgtctcacgaccggtgctcgatttagagtgagctcgttgggtttgggggaggaactgctcagttaggacccagagggaaccatggaagcccagctcagcttctcttcctctgctactctggcctccagataccaccggagagtattgtgttcgacacagtcctccacgccaccttgttctttcgtctccggaaggggaaanacgcctactcctctcctcgcgacgggccagtcaggtactacgttaacccaaccgtagtttacgaccgttaggaaacccaaacgaacaaaccgtggccgacggcctacccgaccggcccttatacttcgtttagactcgcctactcctacgtccgtacggccacgtcggctacgtcccacgccgtacggttacgaggtcggacgtagggttcgggtcgtagggtaacctacgtacgttacgaccgttactaccgtaaccgtacgtacgacggtacctacggtacgttaacgacggtaccgttaagtaaacggtttcgttttacggaacttttaagtttaaccgttagttaccgtaaacgttaacgtaaccgttaacccggttaacggtaccgggttacccggggtccccgggtttaaccgggggtacccctttacggggtttaccccgggaacccgggtttaaggttaaaccccggtaaaagttcggtaaacggtaaccgttaaccggtaaaaacggttccgtaggggtaacccgtacggttccgaaaccgtaacccttacggtttaccgtttccctttaaccgttaccctaccggtttccccgttaacccc

SEQ ID NO: 102038 - DNA, 700 bp, Homo sapiens
  misc_feature: GYAE6OF01E3GR0.9.33.C11.1.454.CMB.1.raw
  modified_base (676)..(676): a, c, t, g, unknown or other
  misc_feature (676)..(676): n is a, c, g, or t
tcagtgatacgtctcacgaccggtgctcgatttagagtgagctcgttgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcacgtgggtccgccaggcctccgaggcaaggggcttgggagtggctggcagttgttcatctgaaggagtgttcaatactatacagacctcgtgaacgggccgtattcaccatcctaccagtagactaacttaccaaacgaacacgatgtatctgaacaagtggacacgacctaaagagttggaggacgacggtcttagtttattacgtagtaacggtaaagggaggggggtactaagacgggtaggcgagtccgtaaccgtaagttaaccttacgtttagtaccgtttcgggtcggggaccgtaacggggtaaccccgttggtacccgtcccggttccttcccgtacgtaccgtacccctacccgtaacccgggaaccgggtacccctaacggttcccggtaccccgtttccccggtcggccccgtacccggtcgtcccgtcccggagggacccgccctacccgacccggaacgaccgtacggaaccncccgggtcccgggcccgtacgggg

SEQ ID NO: 102039 - DNA, 835 bp, Homo sapiens
  misc_feature: GYAE6OF01DW6SX.9.33.C11.1.454.CMB.1.raw
  modified_base (201)..(201): a, c, t, g, unknown or other
  misc_feature (201)..(201): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgctcgaggggaaancgccacctctctgcagggccagtcagtagtcgttaaccaccgtagtttacgccttaggtaaccaaacgacaaaacccgtggacccaagggcctaccccgaacggtccccctactacttccttttcggactcggctactccaacgtccgacggggaccacggtggaccacgttaccccaggtcccctaagggtttccgaagggttcggaccgtaagggttcggggtcgtacgggggactaacgggtaccttacacctcgtaccaaccattaccgaggaccacgtacccgttaacggacgtacccgtagtaaacggttacgtttttacggaccgtttaaaggtttttaacgttaaccgttacggtttaaaccctaaaccgttaacgttacccgggtttaaacccggtacggggtttaccggggaaccccggtttccccgggggggaccctttaacccggtttcccggggttaaccccgttaacggggtaaacccgttaaaacgttcgggtaaacggtaaccgttaaccgaaaaaccggttaacgttacggggtaccggtactaccggtacccgtaaccttaccgtaccgtttacgttaccctttacgtaccgtttccccgttaccccggtaacccg

SEQ ID NO: 102040 - DNA, 752 bp, Homo sapiens
  misc_feature: GYAE6OF01BTE42.9.33.C11.1.454.CMB.1.raw
  modified_base (156)..(156): a, c, t, g, unknown or other
  misc_feature (156)..(156): n is a, c, g, or t
  modified_base (203)..(203): a, c, t, g, unknown or other
  misc_feature (203)..(203): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccacggagagattgngttgacacagtctccagccaccctgtctttgctccgaaggggaaacncgtcccacctctccgtgacagggccagtcaggtctgttacccacctagttgccgttaggtaaccaacaacaaccgtggaccaggcctaccacggccctcatcttgatgctaatccatcgagggcccagtggcctacgtcccaagcctaacggttcaacgtcggtacgtacgggttggggtaccttaggggaaccaaacggtccttaccgtaaccttcctaaccgaacccgtaattccaacgggcccaacgtacccgtaaggacgtacccgtaggtaaacgttagttttacggtaccgtttaaggttttaaccttaaccggttaacggttacctaaaaccgttacgtaccccggttaaaccggtacggttaccggggtcccggtacccccggggggtccttaacccggtttcccgggaccccgtaacgggaaaccccgttaaaagttacgaaaggtacctaacgaaaaccggttaccgtaggtacggttaccacggtaccacccttaagtaccgttacgtaccttaccgtacgttcccttcccggtaccc

SEQ ID NO: 102041 - DNA, 797 bp, Homo sapiens
  misc_feature: GYAE6OF01CZF8S.9.33.C11.1.454.CMB.1.raw
tcagtgatacgtctcacgaccggtgctcgatttagagtgagctcgtttggggtttgggggaggaactgctcagttaggacccagagggaaccatggaagccccagctcagcttctcttcctcctgctactctggcctcccagactacccgaccggagagtattgtgttgacactagtcctccacgccctacccttgttcttttcgtccgtacccggaagggggaaacgacgccctaccccttccttcccgtacggaccgaacggggccctaggtcgaggtacgttacgttaaccccaacccgtaggtttacgacccgttacggtaacccaaacaaccgtaaaacccgtcggaccgaacggtccctacccccgaccggtccccctactacttcctttagacgtcgacactccgaagtccggacgggacccacggtccggacctaaccgtaccccgaacgtaccgtacggttcgacgggtcggtacgtacgggttcgggtacgtacggggtaacctaacgtaccttcctaccgttacctaccgtaacctacgtaccgacggacctacgtaccgttaacggacgtaccgttaagtaacgtttcgttttacgacttttaagtttacttacgtctaactaacctgttacccggtacggtcggtccgggccggttcccggggtaccttaccggtttccggaccgtacggtaaactaaaggtcgaaacgtaactaaccggaaacgtagtcggtcgactacgtaccacgttactcgttcttacctcttaccgttcccgtccgtac

SEQ ID NO: 102042 - DNA, 860 bp, Homo sapiens
  misc_feature: GYAE6OF01BIAC5.9.33.C11.1.454.CMB.1.raw
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagtgatacgtctcacgaccggtgctcgatttagagtgagctcgtgggagaggagcccagcactagaagtcggcggtgtttccattcggtgatcagcactgaacacagaggactcaccgatggagtttgggctggagtcgttcgggttttcctcgttgcttcgttttaaaggnggtgtccagtgtacagtgactacgtggtggngtcggtgggggggctggtccagccgtggggacgtcccngagcctctcgtgngcgaggtctcgtggtatttccaaccgttcaagtaaccgtacggcgtcgacctacggtcgggtcccgaccgtaggccctaccggacggtacggtaacggggtccgttagggacgtcgggtcccgttagggtaccgttagggtttttcttttaccgaagtttccggtaagggtaaaggtaacggtttcgtttaaaccaaactttaacgtaacgtacccgtaacggtacccgttcgggtaacggaacggggtcctaacgttaccaaccttagtccccgtagaaacgtaccgtaacctaaacgttaccccgaaaacgaacctaaccggtagttacgtaacttccgtaagaccgtaaaggtacgtaacctacgggtaaccgtaaaggttaggtaaccggaacggggttaaccctcggggttttaactttaacgggttttaaccgtaaggttaaaccggggttaaaggaaacgggggggtttaaaccgggacttaaaacgggtcgggtttacggaaccccgttacgtaaccccggtttaacccggtaaaccgtttaacggtttttaaccccgttcgggtaaacccggttttcccggggtaaacccggggg

SEQ ID NO: 102043 - DNA, 853 bp, Homo sapiens
  misc_feature: GYAE6OF01D19MQ.9.33.C11.1.454.CMB.1.raw
  modified_base (210)..(210): a, c, t, g, unknown or other
  misc_feature (210)..(210): n is a, c, g, or t
  modified_base (329)..(329): a, c, t, g, unknown or other
  misc_feature (329)..(329): n is a, c, g, or t
  modified_base (436)..(436): a, c, t, g, unknown or other
  misc_feature (436)..(436): n is a, c, g, or t
tcagtgatacgtctcacgaccggtgctcgatttagagtgagctcgttgggtttgggggaggaactgctcagttaggacccaggagggaaccagtggaagccccagctcagcttctcttcctcctgctactctggctcccagactaccgaccggagagattgtgttgacacagtcctcacgcccaccctgttctttgtctccgaggggaancgccaccctctcctgcagggcctagtcagtagttcgttaacccacccgtagttacgccgttagggtaaacccaacaaccaaaccgtcggacccacggccctaccccgacggtcccctanacgttccgtttagactcgactactccattccggaacgggccctacgtcggaccaccgtcccgagtacccgtaggtttccgagggtcggacgtacggtgggttaccgnggggtaaccacggttaaccttctaccctctacccaacctcgtaaccgacgtaccgacgttacccgtaagtcccggtaaccgttaggttaaaacgtttcgtttttacggacttttaaacgggttttactttaaccgttacggtaccaaaccgttaacgggttcccgtaacgggttaccgggtacccgggttcccgggttaaccccggggggtcccctttaaacccgggtttccccgggtaaacccggttacggggtaaaaaccctttaaagggtaccggttaaaccgtaaacgtaaacccggtaaaaccgtaacggttacgggtaccggtacggtaccggaacccttaacccggttattacccgtttaacggttaccctttaacccgaaccgtttccccgttaccccggttaacccgg

SEQ ID NO: 102044 - DNA, 809 bp, Homo sapiens
  misc_feature: GYAE6OF01B2IA3.9.33.C11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccgaccggagagattgtgttgacacgagtctccagccaccctgtctttgctccgaggggaaancgccaccctcncctgcacgggcagtcagagtcgtaccaccctagtacgccgtacggtaccaaaccaacaaaccgtcggaccaacggtccctaccccgaacgggtccccccttacgtaacttccgttttaggacttcgacctaacctaccgtaacgtaccggacgggtaccctacggtcgggtacctaccgttaccccgaacggtcccgtaacggtttcgacgggtacgggtaccgtaagggttcggggtacgtacgggggaactaacggtaccttaccgacctccgtaccaaccgtaacgtcccgaagtaccgacgtaccgtacggtaaccgtccgtaaggtaattagtttacgacgtttaagttttactaacgttagtaacctaacgttacgtaccgtacggtacggtccgggtcccggtacccgggtaccgttacccggtttacccgggtacccgttaacgggtaaaaccttaacggttaacgggtaacctaaccggttaaacgaaaccggtaaaccgttcggggttaacgtccgtacgggtcctaaacgttcggttacctttacggtacctttaccggaccctttcccgtcccgtaaccg

SEQ ID NO: 102045 - DNA, 947 bp, Homo sapiens
  misc_feature: GYAE6OF01C31L2.9.33.C11.1.454.CMB.1.raw
  modified_base (174)..(174): a, c, t, g, unknown or other
  misc_feature (174)..(174): n is a, c, g, or t
tcagtgatacgtctcacgaccggtgctcgatttagagtgagctcgtgggagaggacgcccagcactagaagtcggcggttgtttccattcggtgatcagcactgaacacgagaggactcacagtggagtttggctgagtcgttgggttttcctcgttgtcgttacgtttaaggnggttcgtccgaggttgtacgtaaaggttgaccgtaaaggttggggtagggtacgggttccgggggtgggggggggtccttacgggtaccggacggtccgggtaggggaccggttcccgtaggtacgtccttcgtccggtggtcggacgtcggtcttcggtaggttacttaccctaaccgtttacgaacggttaaccgtaccgggtcgtccggacggttacccgggtccggggtacccgaccggaacgggtccctaacggacggggtacggttaacggggttcgttaggggacgggttcggtacggttaccgggtagtttacggttttacgtttaccgaagtttacggaagggtaaaggtttaacgttacggttaaactaaacgttaaacgtaaccgtacgaaccgggttaccgttacgggtaaagggtaccgggtaccttacaacctacgtaccgtaccgtaccgaaagaacgtaactaaacgttaaccggaaactaacaacggtagttacggtaaactccgtaaaacggtaacctaaacgggtacggaacttaaaccgggtaccggttaaaggttacggttaacgggaaacgtaaccgtttacggggtttactttaagttttaaccggtaaaccggttaagggtaaaccggggaaaggggtaaccggggttaagttaaacgggtaggttaacggccggttaaaccgtaccttaacggtttaaacggtaaccgtttaccggtttcggtaacccggtttcggggtaacccgggg

SEQ ID NO: 102046 - DNA, 630 bp, Homo sapiens
  misc_feature: GYAE6OF01B5X75.9.33.C11.1.454.CMB.1.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaanagccaccctctcctgcagggccagtcagagtcgttaccacccagttacgcctggtaaccaacacaaacctggccaggcctcccaggcccctcattctttgatcgcatccatcgacgggccagtggcactcccagccaggttcaggtggcaggtcggggtctggggacngtacttcacgttcaccacctatcagcacgcctagacgtcctagtaacgttagttttcgtacgtttagtttaacttacttagtacctaacgtacgttccggtaacgtaggtccgggtcccggtcccgggggtaccttccggtttcccgggtacccgttacgggaaccctaaggttacgaagtacgtaacgaaacgtacgtggtcggactacggaccactacttccgttcgttccttactaccttccgttcccgtaccg

SEQ ID NO: 102047 - DNA, 705 bp, Homo sapiens
  misc_feature: GYAE6OF01CVAQJ.9.33.C11.1.454.CMB.1.raw
tcagtgatacgtctcacgaccggtgctcgatttagagtgagctcggttggggtttgggggaggaactgctcagttaggacccagagggaaccatggaagccccagctcagcttctcttcctcctgctactctggctcccagatacccacggagagtattgtgttagacacagtcctccagcccacccttgtctttgactaccgaggggaaagcgcccaccctctacctgcgagggccagtcaaggatcgtaaccaccagttacgcctaggtaccaacaaccaaaccgtcggacctaggacctacccgacggtcccctatacttctttagatcgacataccagtcgacgggccacgtggacactcccgagccctaggttccaggtgacgtaggtcgggtcgtacgggacacgtaaccttcaaccttcgtaccaactaagtccgaacgccgacgtacccgtaaggaccgtaccgttaggaaacgtttagtttttcgaacgtttaagttttacttaacgtacgttacgaaacgtacgttaccggtaacccggtaggtccgggtacccgggttacccggggaccttacccggtttccgggaccccgttagggaaaccctaaaggttgaacgtaaactaccgaaaacgtagtggtacggctacgggaccaaccgtattcgtctaaccttcgaaccttcccgttcccgaac

SEQ ID NO: 102048 - DNA, 979 bp, Homo sapiens
  misc_feature: GYAE6OF01AFN93.9.33.C11.1.454.CMB.1.raw
tcagtgatacgtctcacgaccggtgctcgatttagagtgagctcgtgggagaggagcccagcactagaagtcggcggtgtttccattcggtgatcagcactgaacacagaggactcaccatggagtttgggctgagtcgttgggttttcctcggttcgtcttacgttttaaggaggttcgtcctagtgtacaagtgacaacgtggtggaggtcgggtgggggggactggtccgaggtccggtggggtaccgtcccgtggtacgaccgttccgtccgtggtacgccgtaggtccgttcgtaggttaccttaccctaaccgttacgaacggttaacccggtacgggtcgtcggtaccgtaccggttccggggcccccgtaccggtaccggtacccgtaccgggaacgggaacccggtaacggggttcgttcgggggtagttccgggtaccgttcgggtaccgtttaggtttccgtttaacgacgggtttaccggttaaagggtaacggtaaacggttttacgttaaaccttaaacgttaaccgttaacgtaaaccggtaccggttaaccggttaacccggggttaacgggtaaacccgggtacctttaacccgtttaccccgaaccgtttaccgtttacccggaaccgtaaacggtaaaccgttaaaccttaaacccggttaacccgtaaaaacggtaacccgtaaaccgttaggtttaacgttaacccgttaacggtaaccgtaaaccgtaaaggttacccggtaaactaaacccgggtaacgttaaagggtaacgttaaccgggaccgttaacggttaccgttacgttttacggttaacgtaccgggtaaggtaaccgggtaaagggggtaacgggttacgtaaacgggttacggtacggtacccgaaccgttacccgttaaaaccgttacggtttaacccgtttggttaacccggtacgggtttcccgggaaccgggg

SEQ ID NO: 102049 - DNA, 658 bp, Homo sapiens
  misc_feature: GYAE6OF01CJLYD.9.33.C11.1.454.CMB.1.raw
  modified_base (182)..(182): a, c, t, g, unknown or other
  misc_feature (182)..(182): n is a, c, g, or t
  modified_base (571)..(571): a, c, t, g, unknown or other
  misc_feature (571)..(571): n is a, c, g, or t
  modified_base (585)..(585): a, c, t, g, unknown or other
  misc_feature (585)..(585): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccngccctacccgacttaaaccgggacaaccgtcgcccggaccaacatacgccttcctcccgtcccccttcgcagtaacaccaagtacaggaactattaacctcgttccatcgactaccgcctttcggcctcgccgttaggggtccactccaccctcgacccgtaattaacgtggacacggtaacccttggtccttccggcgacggtcggtccttttccacccgtcttttactcgttacttatgtcagctattcgactacttcacgtactacctccagtcagtccgcctacaccagacccaacctaccttacactacggtccttaacgacgacccgtaccctacccccgtaacccaactaaccgactaacgtacgccgtaccgctccgaccncgacgtcgtcggtnccgttagttccggttccgtacccctttactccctcccgttcccacgtacttaccgagtaaccgtgtaactacg

SEQ ID NO: 102050 - DNA, 716 bp, Homo sapiens
  misc_feature: GYAE6OF01C5903.9.33.C11.1.454.CMB.1.raw
  modified_base (217)..(217): a, c, t, g, unknown or other
  misc_feature (217)..(217): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccgaccggagagtattggtgttagacacagtcctaccagccctaccctgttcttttgtctaccgaaggggaaancgcccacctctcctgcgaggccagtcaagcgttcgttacccaccgtagttacgccgtaggtaaccaacacaaaccgtggaccacggcctcccgacggtcccctacacttcgtttagactcgctactaccagtaccggacggtacccacgtcggacctacctaccccgacggtaccgtacggtacgtacggtgggtacgtagggtttcggggtccgtaggggaacctcgtaaccgttcnccgtaccnccgtaacacgttacacgacgacgtacgtacggaccgtaccgtagtaagtctttttacgaagtttaactttacgttacttctaaccgtaacgtacggtaccgttacggacggtcccgggtcccgggtaccgggtacccttaccggttcccggaccgtaccggtaactaacgttcgaataccgtaaacgaaccgtgtacggtcgtaccacaccgtaccttcgttctacctttcgtaccttaccgccgttcccacg

SEQ ID NO: 102051 - DNA, 551 bp, Homo sapiens
  misc_feature: GYAE6OF01BFV6M.9.33.C11.1.454.CMB.1.raw
  modified_base (199)..(199): a, c, t, g, unknown or other
  misc_feature (199)..(199): n is a, c, g, or t
tcagtgatacgtctcacgaccggtgctcgatttagagtgagctcgttgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccnccaggctccaggcaagggcttggagtggctggcagttgtttcatctgaaggagtgttcaatactatacagactccgtgaagggccgattcaccatctccagagacaattccaagaacacgatgtatctgcaaatggacagcctaaagagttgaggacacggctgtttatactgtacgaaagagggggatacagtggcagctccaagtactactttgacttcgtggggccagggaaccctggtccacgtctcctcagccctccaccaaggcccatcggtccttcccctggccgccctcgcgtcccaggacgccacccgtccgacggacgaccacacggccgggcccgtcgggg

SEQ ID NO: 102052 - DNA, 746 bp, Homo sapiens
  misc_feature: GYAE6OF01CPA1P.9.33.C11.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctccagatacccacggagagtattgtgttgacacagtctccagccctaccctgtctttgctaccgaaggggaaancgcccacctntcctgcgagggccagtcaggtagttcttaacccacctaggttacgccgttacggaaccaaactaacctaaaccgtcggacccagggcctacccgacggtccccctatacgttacttagacgtcgtacctaacttccgtaacgttccggaaccgggtacctaccggttacgggactaaccgttaccccgacggtacccgtaggttacgacgggtcgtaccgtagggttcggtacgtaggctagtacctcgactcacactatcgacgacacgacgtagacgtaccgtaagtaatttacgttcgtaactttagtttacgttacgtcgttaactaaaccgtacgtacccggtacgttacggcccgggttacccgggtaccgggtcccttacgggttaccccgtaccggtaaggtaaaccttaacgttcgaacgtaacgtaaactaaacggtaagtccgggtaacgtcgtaactaccgtaaccgttacgtccggttacttacttaacccttacgttccccgtacccgttaccg

SEQ ID NO: 102053 - DNA, 766 bp, Homo sapiens
  misc_feature: GYAE6OF01DAM3K.9.33.C11.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
tcagtgatacgtctcacgaccggtgctcgatttagagtgagctcggttgggtttgggggaggaactgctcagttaggacccagagggaaccatggaagccccagctcagcttctcttcctcctgctactctggcctcccagactacccgaccggagagtattgtgttgaacacagtctccagccctacccttgttctttgtctccgaaggggaaacncgcccaccctctccgngccgacgggccaagtcaaggtagttaccgtaacccacctaggttaccnccgtacggtaaacaaccaacgaaaccgtcggaccgacggtccacccgacggtcccctatattccttgatcgactactcctaacgtccggaacggtaccctacgtcggacctaccgtacccgaaggcccggttaacggttcggaacggttcggacgttaagggtccgggtacgtacgggactacggttactaccgacctctaccaccgtatacgacacgacgtaccgtaaggaccgtaccgttagtaacgttacttttcggaattaacgttttacgtacttacgtaactaccggtaactccggtaaccggtaggttccgggtacccggtccgggtcccttacggttaccccggtacgtaaccgggaactaaacgtagtaacgtaacctaacggaaacaccggtaggtaccgaccggttcaacccgttaccgtactttaccggttaccgttaccttacccgttaacctttccccggcccccttaacg

SEQ ID NO: 102054 - DNA, 737 bp, Homo sapiens
  misc_feature: GYAE6OF01E0N97.9.33.C11.1.454.CMB.1.raw
tcagtgatacgtctcacgaccggtgctcgatttagagtgagctcgttgggtttggggtacgatttgatgttacctgatgcttagaggtcttttcctggaagcagggcatttgttgcttcagcaccgtagtgcctcgtcatcacgcctcagtccttgtacttttccggatttgcctaggaaaaccacgccctaacccgcttaaaccgggacaaccgtccgcccggccaacatacgccttcctcccgtccccccttgcacgtaacaccaagtacaggaatattaacctgttacccatcgactacgcctttcggcctcgccgttagggcactcaccctcgaccccgtattaacgtggacctacggtaaccccgttggtaccgttcccgggcgacgggtccgggtcctttttccgacccgttcttttacgtccgtttacttagtcgtacagtcctagttccgctactttctacgaccttaccctccagtcctaacttcgccctacgaccacgaccctaaccctaccctttaccaaccgtaacggtacctttaaccgaacgtaaccccgtcccttaacccccctaacccaaccgtaaccgacctaacggtaacgtaccgtccgtaccgtccgtaccggactacgtccgttccggtcgaccgtaacgtttacgggttcccgttaccccgtttactaccgttacccgtcccgtctacgtccgtaaggtaactccgtacgtaccg

SEQ ID NO: 102055 - DNA, 850 bp, Homo sapiens
  misc_feature: GYAE6OF01B2G6V.9.33.C11.1.454.CMB.1.raw
  modified_base (219)..(219): a, c, t, g, unknown or other
  misc_feature (219)..(219): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgcctactctggcctcccagataccaccggagagtattgtgttgacacacgtctccacgcccacccttgttctttcgcctaccggaaggggaaagacncccaccctctccgtgcgacggccagtcagtacgtcgtaacccacctagttacgctacggaacaacaacaaccgtcgaccgcggacctccgaccggcccctactacttcgtttacgagtcgtacctactccgacgtacggacgggaccctacgtcggacctaccgtacccacggccgttaacggttccggaggtcggtcggtacgggttacgggacgggttacgggtaacgaacgtacgttacctaccgtaccctaaccctacgtaaccttaccgaaaccgcgtaccggtaaccgacgggtaaccgtccggtttaaaggtaagttttacgttttaccgggtaacctttaggttttaaactttccgggttaaacgttaacctaaaccgtacggtttacccgggttaacgggtaccgggtcccggggtttacccccgggtaccggggtaccccgttttaccgggttacccccggggtacccggtttaaaccgggtaaaacgtttaaccgggtacgtaaccggtaaaccgttaccggtaaaacgttaaccggtaggtccggtaactcggtaaccccaacgttcccggttaacttccggttactttaccctaccgtttacccggttccctaacccg

SEQ ID NO: 102056 - DNA, 782 bp, Homo sapiens
  misc_feature: GYAE6OF01AOG7R.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgcccaccctctcctgcagggccagtcagagtcgttacccacctagttacgcctggtaaccaacaaccaaaccgtggccaggcctccccgacggcccctcattcctttgatcgcactccatccgacggcccacgtcggccacgtccccacggcctacggttcgaggtcggcgtaggttggggtcgtaggggactaacgtacttcacgtccctaccaccgtactccgaacgaccgacgtacccgtaaggtaccgtacccgtaaggtaaacgttacgttttacggtacgttaagtttttaacgttaccgttacggttaacctaaacgtacgttacccggttaacgggtaccgtaccggggtaccccggttacccggggggtaccccttaacccgggttttccccggggtacccgggtttaaccggggtaaacccttaaaacggttacggaaacggttaacgtaaaccggttaaaaccgaaccggttacgggtcggtacccgttacggtacccgtaacccgttacgtttaccggttccgtttacccttaccttaccgtttccccgttcccccgttaacccg

SEQ ID NO: 102057 - DNA, 718 bp, Homo sapiens
  misc_feature: GYAE6OF01C7AMC.9.33.C11.1.454.CMB.1.raw
  modified_base (517)..(517): a, c, t, g, unknown or other
  misc_feature (517)..(517): n is a, c, g, or t
tcagtgatacgtctcacgaccggtgctcgatttagagtgagctcgttgggtttggggtacgatttgatgttacctgatgcttagaggtcttttcctggaagcagggctatttgttgcttcagcaccgtagtgcctcgtcatcacgcctcagtccttgtacttttccggatttcgcctaggaaaaccacgccctaacccgaccgttaaacccgggactaacccggtccgacccggaccaacactacgtccctttcctccccgtccccccttcgactaacgtaaccaacctaagtaccaaggtaacttacttaaccctcgtttacccatcgtactacgtccgtttcgcctcgcgttagggcactccacctcgacccgtattacgtgaccgtacgtacccttggtccgttccggcgacggtccggttctttccgaccgttgtttactcgttacttatcgtcagctactcgctctctagtactaccgtcagtctactcgcctacacgtctaccacttaccncacgtacgtaccttacgaccgaacctccccgtaaccccctaacgaacgtaaccgctaacgtaccgtccgtaccgtccgtaccgcccgactaccggttcgtacggtctaaaccgttcggtttaaccgtttcccggtcccctttactcccttacccggttaccccgacttacgttacgtaacgaacggttccttagtacccgg

SEQ ID NO: 102058 - DNA, 791 bp, Homo sapiens
  misc_feature: GYAE6OF01DADYC.9.33.C11.1.454.CMB.1.raw
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagtgatacgtctcacgaccggtgctcgatttagagtgagctcggttgggtttgggggaggaactgctcagttaggacccagaggaaccatggaacgccccagctcagcttctcttcctcctgctactcgtggcctccgagactaccgacggagagtattgtgttagacacngtcctaccacgtccctacccttgttctttcgccgtaccggaaggggaacncgcccctacccttcgtccngcgacggccagtacgagtacgttctaacccaccgtagttacgccgtacggtaaccaaccactaaccgtcgaccgacggcctacccgacgtcccctatacttcttgatcgactactccgacgtcggaccgtcctacggtcggacctacccgtaccgacgtacgttacgtccgtagggtcgtcgtagggttcggtacggtacgggaacctacggtccttaccgacgttaccaccgtactacgtacaacgccgaacgtccgtaggaccgttagttaagtaacgttttacgtttacgaacgtttttaacgtttaccttaacgtaaccgtactaaaccgtttccgggtaaccggtccggtacgggttccccggtccccgggttaccgggtccccttttaaccgggttcccgggaaaccgggttaacgtaaaacccgttagggtgtaaacccgttaaaccgtacgggtaaaccgttacggtcggtaacgtccgttacccgattacccggtacttccggtttccttaacgttcccgttaaccctcccgttacccga

SEQ ID NO: 102059 - DNA, 799 bp, Homo sapiens
  misc_feature: GYAE6OF01ANTZD.9.33.C11.1.454.CMB.1.raw
  modified_base (225)..(225): a, c, t, g, unknown or other
  misc_feature (225)..(225): n is a, c, g, or t
  modified_base (772)..(772): a, c, t, g, unknown or other
  misc_feature (772)..(772): n is a, c, g, or t
tcagtgatacgtctcacgaccggtgctcgatttagagtgagctcgttgggtttgggggaggaactgctcagttaggacccagagggaaccatggaacgccccagctcagcttctcttcctcctgctactcgtggcctcccaagactacccgaccggagagtattgtgttgacactagtcctccacgccctacccttgttctttcgccgtaccggaaggggaaacncgccctacccttctccgtgacgacgggcctagtcaggtacgttaccgtaacccaccgtagttacgccgtacggtaaccaaacaccgtaaaccgtcggacccgacgccctacccgacggtcccctctactttccgtttagactcgacctactccgtagtaccggaccgggtacctacgtcggtacccaccgttaccccgacggtaccgttaacgttaccggagggtccggacggttacgggttccggggtaccggttacggggacctaacgtaccgttaccgtacctcccgtaccaaccttaacgcccgtacgaccgtaccggtaccgtaacggtaccgtcgttaagtacgtttacgtttacgtacgtttaatttactactacggtaactaaccgtacgttcccggtaacggtcggtacccgggttccggtcccgggtacttaccgggttacccgggtaccgtaacggtaactaagtagaaccgtacaacgtaaccgtcgtacgggtactaccgtacgtcctaccggtacttaccggttcctttaccnccggttaacccttcccgttaacctacg

SEQ ID NO: 102060 - DNA, 744 bp, Homo sapiens
  misc_feature: GYAE6OF01CNO6M.9.33.C11.1.454.CMB.1.raw
tcagtgatacgtctcacgaccggtgctcgatttagagtgagctcgttggggtttgggggaggaactgctcagttaggacccagagggaaccatggaagccccagctcagcttctcttcctcctgctactctggcctcccagataccaccggagagtattgtgttgacacagtcctccacgccctacctgttctttgtctaccgaagggggaaacacgcccaccctctcctgcgacgggccagtcagagttcgttaaccaccgtaggttacgcctaggtaccaacaacaaaccgtcggaccaggcctaccccgacggtcccctactattccgtttagactcgactactcctacgtccgacgggtcccacgtcggaccactcccgaacgccgtaggttacgacggtggccgtagggtcgggtcggtacgggaactacggtacttccacttccacaactactcacgcacgtaccgtagaccgtacgtagtaaagttcttttacggactttaacgtttataccgtactaccaactacggttaccgtaccggtacggtcccgggtccgggttcccggggtaccttcccggttacccgggtacccggttaacggtaaacggttaaacgttcggaaaccgttaacgtaccgtaaaaccggttacgttcgggtacggttaccgtacggtacccctaacgttacgttccgttaccggttaccttacggttaacccttccccgttacccgtacg

SEQ ID NO: 102061 - DNA, 784 bp, Homo sapiens
  misc_feature: GYAE6OF01BJKE7.9.33.C11.1.454.CMB.1.raw
tcagtgatacgtctcacgaccggtgctcgatttagagtgagctcgttgggtttggggggaggaactgctcagttaggacccagagggaaccatggaagccccagctcagcttctcttcctcctgctactctggctcccagataccaccgggagagattgtgttgacacagtctccacgcccacccttgttcttttgtcctccgaaggggaaagacgcccacccctctcctgacgacgggccagtcagtagttcgttacccaacccgtagttacgccgtacggtaaccaacaaccaaaccgtcggaccgacggccgtcccgaccggcccctctacttctttacggatcgtacactaccagtacggacgggccctacgtcgacctacgccccgacgtacccgtacggttccgaggtcgggccgtaggttcggggtcgtagggaacgtacgtaccttaccgtaccttaccgtaccctacctactaccgtacgaccctacggtacccgttaacggaaccgtaccggttaggtaaaacgtttcgtttttacgacttttaagttttacgttaaccgtttacggtacctaaaccgtcggttaaccggtaccggttacggtcccggggtcccgggtacccgggtaccgttaccccggttccgggtacccggtacgggtaaaccctaaggttcgaacgaacgtaacctaaaaggtaccgttaggtcgtaccgtacgaccctacgttccttacgttccgtttaccgttccgtaccttccccggttcccgtaccg

SEQ ID NO: 102062 - DNA, 675 bp, Homo sapiens
  misc_feature: GYAE6OF01D6VE4.9.33.C11.1.454.CMB.1.raw
  modified_base (185)..(185): a, c, t, g, unknown or other
  misc_feature (185)..(185): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
tcagtgatacgtctcacgaccggtgctcgatttagagtgagctcgttgggtttgggggtacgatttgatgttacctgatgcttagaggtcttttcctggaagcagggctatttgttgcttcagcaccgtagtgcctcgtcatcacgcctcagtccttgtattttccggatttgcctaggaaaccngccctaccgacttaaaccggacaaccggtccgcccggacaacatacgtcccttcctcccgtcccccttgcaacgtaacaccaagtacagaatacttacctcgttaccatcgtactaccgtcctttccggctcgtccgttaggggtccactccacccgtcgacccgtattaacggtcgacgtacggtaccttggtcctcggcgagtcggtctttaccnccgttntttatcttacttatgtcatctatcactattcagtactactcngctatcgacctcacncgcctaccgtaccttacacgtacggaccttaacgaacgacctccctaacccctacgaacacgactacaagtccgtacgcgtaccgccgtacgacgtccggttggtaccgtactaccgggtttacgggttaccccgttcccgtttacttcccgtttccccgttcccaccgttacttaaccgttaacgggaacccgttacgttacctaccgg

SEQ ID NO: 102063 - DNA, 874 bp, Homo sapiens
  misc_feature: GYAE6OF01EWPDA.9.33.C11.1.454.CMB.1.raw
  modified_base (131)..(131): a, c, t, g, unknown or other
  misc_feature (131)..(131): n is a, c, g, or t
  modified_base (210)..(210): a, c, t, g, unknown or other
  misc_feature (210)..(210): n is a, c, g, or t
tcagtgatacgtctcacgaccggtgctcgatttagagtgagctcgttgggtttgggggaggaactgctcagttaggacccagagggaaccatggaacgccccagctcagcttctcttcctcctgctactcnggcctcccagactacccgaccggagagtattgtgttgacacagtctccagccaccttgttcttgtctcgaaggggaaancgcccaccttctcctggcaggccagtcaggagttcgttacccaccgtagttacgccgtacggtaaacccaaactaacccaaaaccgtcggaccacggtccctcccgaccggtcccctacgtactttcgtttacgacgttcgacctactaccgtacgttaccggacgggtaccctaccggtacggaccaaccgtaccccacggtacccggtacgggtttcgaacggtcggaccggtagggttcggggtccgtaagggggtaaccgtaaccgtacctttaccgtacccgttacccgtaacccgtaacccttaacgttaccgaaggtaccccttaacggtacccggtaacccggtaccggaaccggtttaagtttaaaccgtttaacggtttttacggttaacgtttaacgttttttaacttaccgtttaacgttaacccgttaaaccgttaacgttaacccgggttaacccggttaacgggttcccggggttaaccccgggttacccgggggtttccccgttaacccgggtttcccgggtaacccggtaacggggtaaacccttaaggttacgtaacgttaacgtaaacccgtaaacgtaccgttaggtccgacgttaccgacctacgtactccttacgttactacctccgttacccgtccgtacc

SEQ ID NO: 102064 - DNA, 922 bp, Homo sapiens
  misc_feature: GYAE6OF01D5ICV.9.33.C11.1.454.CMB.1.raw
tcagtgatacgtctcacgaccggtgctcgatttagagtgagctcggttggggtttgggggaggaactgctcagttaggacccagagggaaccatggaacgccccagctcagcttctcttcctcctgctactctggcctcccagatacccgacggagagattgtgttcgacacgagtcctccacgccctacccttgttctttcgtaccttaccggaaagggggaaacgaccgccccaccccttcgtcccgtggccgacggggccagtcgagtacgttaccgttaacccacccgtagttacgcccgttacggtaaacccaacgaacctaaaccgtcggacccgtaacgggtccctaccccggacccggtcccctacgtaacgtttccgtttagactcgtactaacttacccgagtacccggaaccgggtccctaaccggtccggtaccctacccgtaccccgacggtacccgttacgggttaccgagggtaccgggtaccggttagggttccggggtacgtacggggaaccgtacggtttaccttacccgtacccgtaccctaccctaacgtacgtaccgaacggtaccgtacggtaccgtaacggtacgtacccggttagtaaacgttttagttttcgtaaacgtttagtttttacgttacttaccggtaacctaaacgtacggtttacccgggaaccggttcggggtaccgggtccccggggtacccgggttcctttaccccgggtttacccgggtaccccggttaaggggttaaaccccttaagggtaccggtaaccttaacccgtaaaccgtaaaccggtacgttacgggtaccggtcccttacggaacccctaccgttaacgtttcccggtttacttaacccgtttacccgtttacgttccccccgttccggtaacccg

SEQ ID NO: 102065 - DNA, 1100 bp, Homo sapiens
  misc_feature: GYAE6OF01DKALG.9.33.C11.1.454.CMB.1.raw
  modified_base (108)..(108): a, c, t, g, unknown or other
  misc_feature (108)..(108): n is a, c, g, or t
tcagtgatacgtctcacgaccggtgctcgatttagagtgagctcgtgggagaggagcccagcactagaagtcggcggtgtttccattcggtgatcagcactagaacanagagactcacagtggaggtttggcgtgagtcgttcgggttttcctcgttgtcctttagttttaaaggcggtcgtaccgaggttcgttacaaaggttcgacctaacggttggggtgggtacgggttcggggttcggggggggggtccttcgggtcccgaacggtcccgggttaggggtaccgggttcccttaggaacgtccctttaccgttcccggttaggtccggtacccgtacgggttccgtttcgttacgggtaccttttaccgttaaccctttacgtaaacggtaaacccggttaaccggggtcggttcgtaacccggtacggttcccggggttaccgtaccccggaacggggttcccctaaccggtaacggggtaccgggaaacggggtttccggttaggggacgggttggtcccgtaggggtaccctttaggttttcgtttacccgtagtcggtttaaagggaaacggttaaacggtttcgttaaacgtaaaacgttacttaaacggacctaagggtacccggttaccggtaagggtaaacccgggtcttaaaccttacccgaccgttaacttaccgtaccggtaaataaccggttaaacgaaacgttaccccgtaaaaaacgggaaccttaaaccggtttagtaaacggttttacgtaccgttaacgggtaaaaccgttttaaacggaacccgggttaaacgtaaaccgggttaacccggtttaaaacggggtaaacggttaccgggggttaaaccggttaaacccgggttaaacccgggttttaacgggttttttaacggttttaaaaccgttttaaccggggtaaccgggtttaaaaaagggggaaccggggtaaaaaggggttttaaccgtaaaccgggggttaagggtaaccggtcgttaaaaccggtccccggttaaaaacgttacccgttagttttaaaccgggtttaccgttacgggggttacgtaacccccggggggg

SEQ ID NO: 102066 - DNA, 695 bp, Homo sapiens
  misc_feature: GYAE6OF01BLXQD.9.33.C11.1.454.CMB.1.raw
  modified_base (212)..(212): a, c, t, g, unknown or other
  misc_feature (212)..(212): n is a, c, g, or t
tcagtgatacgtctcacgaccggtgctcgatttagagtgagctcgttgggttggggagaactgctcagttaggacccagaggaaccatggaacgccccagctcagcttctcttcctcctgctactctggcctacccagactaccaccagagagtattgtgttacgacctacagtcctccagcccaccctgtctttgcctccgaagggaaacncgcccaccgtctcctgacacggcctagtccagtacgtcgttacccaccgagttccgcgttcggaaccaacacctaaccgtcggaccaggccctacccgacggcccctacgattccgtttagactcgacctacgtcctaagtccgacggtcccacggtcgacctactccccgaagtcccttaagggttccacggtcggacgtagggttccgggtcgtacggaacctcggtaccttacgaccttcctaccgacctagccgtacgacgaccgtactaacgccgtacgtaagtacgtttattcggtactttaagtttcttcgtacgtaccaacgtcggtcccgtacgtacggtccggaccggttccgggacctacgggtttcccggaccttacgggtaacctaagttcggactaacgttaaccaacgggttactcgggtacgccgtacaccgtactacgttccttacgtctccgtacttcccgtacc

SEQ ID NO: 102067 - DNA, 815 bp, Homo sapiens
  misc_feature: GYAE6OF01D56DR.9.33.C11.1.454.CMB.1.raw
  modified_base (211)..(211): a, c, t, g, unknown or other
  misc_feature (211)..(211): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagtattgtgttgacacagtctaccagcctaccctgttcttttcgtctaccgaaggggaaanacgcccaccctctcctgcgagggccagtccagtacgttcgttacccacctagttacgcctacggtaaccaaacaccaacgtcggaccgacggcctcccgacgtcccctatacgttctttgatcgactactaccacgtccgacggccctacgtcgctaccgtacccgacgacgtacggttaccgaggttacgggacgtacgggttcggggttacgttacggggaacccgtacgttacctttaccgtaaccttccgttaccaacccgtaagtcccgaacgtaccgtaaccgtaccgttaaggaccgtaccgtagttaacgttacgttttcgtaacgtttaacgtttttacttacggttactaaccctaaacgttccgtacccgggtaaccggtaggttacccgggtcccgggtaccccggggtaccgttacccgggtttccgggtaaccccgttaaggggtaaacccttaaagggtttccggaaacgttaaccgtaaaccggtaaaccgtaggttaccggttcggtaccgttacgtaacccgaccgttacgtttcccgttacgtttacccgttaaccctttcccgttcccgttaaccccgtacccg

SEQ ID NO: 102068 - DNA, 857 bp, Homo sapiens
  misc_feature: GYAE6OF01AES7H.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcggttgggtttgggggaggaactgctcagttaggaccagagggaaccatggaagccccagctcagcttctcttcctcctgctactctggcctccagactaccaccggagagattgtgttgacacagtctccagccacctgttctttgctccgaaggggaanacgccaccctctcctgcgacggccagtcaagtagttcgttaaccaccgtagttacgccgttacggtaaccaaaccaaccgaaaccgtcggacccgaacggccctaccccgaaccggtccccctactaactttcgtttagaacgttcgacctacgttaccacgttaccggaaccgggtaccctacggtcggaccaccgttaccccgacggtacccgttaacggttcgtaagggttcgggacggttaacgggttcggggttacggtacggggaaccgtaacgttaacctttaccgtaccgtttaccgtacccaaccgtaacgtacgaacggacctaacggtaccgtaagtaccggtaccgttaagttaacgtttacttttacggtaactttaagtttttaactaaccgttagttaacctaacgttacggttaccggtaaccggtacgggtacccgggttacccgggtcccggggtaacctttccgggttacccggggtaccggttaaccgggtaaacgttaaaggttacggtaaacggtaaacgttaaaccggtaaaaccggttacggttacgggtaccgtaccggttaccgaaccctaaccgttagtccggtttacgtttaccttacctacccgttacccgttcccgttaaacg

SEQ ID NO: 102069 - DNA, 596 bp, Homo sapiens
  misc_feature: GYAE6OF01BM5N3.9.33.C11.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagatgttaccaccagttagcctggtaccaacacaaacctggccaggctcccaggcccctnatctttgatgcatccatcacgggccactggcatcccagcctaggttcagtggcagtcggggtctggggacagtacgttcactctcaccgatccagcacgcctacgacgcctagaagtatttgacgtaagttttattactgtacctaactacgtcgtaccgaggtcggccgtcccgggggcctacgtttccgggacccgttcgggaacgtaaacgttcggaacgtacgtaccgaaacgtaacgtaggcggtacgtcggacctaccgtaacttccgtacgttcttacgtacttccgttccccgtacccg

SEQ ID NO: 102070 - DNA, 703 bp, Homo sapiens
  misc_feature: GYAE6OF01EU1QM.9.33.C11.1.454.CMB.1.raw
tcagtgatacgtctcacgaccggtgctcgatttagagtgagctcgtggggagaggagcccagcactagaagtcggcggtgtttccattcggtgatcagcactgaacacagaggactcaccatggagtttgggctgagtcgttcgggttttcctcgttgcttacttttaaggaggtgtccgagtgtcaagtgacaacgtgggtggaggtcggtgggggggggcgtgggtccaggtcccgtgggggacggtcccgtaggacgaaccttctccgtggttgcgaggcttcgtggtacttccacccgtttacaagttaacctacgggacgtcgctaccggtcgggtccgacccgaggtcctcgacggggacgaacgggggtccgttgggacggtcggtccgtgggccttaggtttctttactagtcggtaaggtaaggtaacgttgttacaattaaccgtagaacccgtaaggtaccgtcgggtaacgggaaagggtcccctattacccactactcaccgaagacgaactaacgtacaaagaaccagtatacgtaatccgagtaactaagtcgaacacgtacgaaggtacggtagacggtactacggtacttaggtttaactggtaggtaaacggaaagggtaggggtaactacggtaggacggcacggtactacgtaacgtacttacgttcgtacgtcggtacgggg

SEQ ID NO: 102071 - DNA, 791 bp, Homo sapiens
  misc_feature: GYAE6OF01B1VTI.9.33.C11.1.454.CMB.1.raw
  modified_base (181)..(181): a, c, t, g, unknown or other
  misc_feature (181)..(181): n is a, c, g, or t
  modified_base (415)..(415): a, c, t, g, unknown or other
  misc_feature (415)..(415): n is a, c, g, or t
tcagtgatacgtctcacgaccggtgctcgatttagagtgagctcgttgggtttggggtacgatttgatgttacctgatgcttagaggcttttctggaagcagggcatttgttgcttcagcaccgtagtgcctcgtcatcacgcctcagccttgtattttccggatttgcctaggaaaaccngccctaccgcgttaaaccgggacaacccgtccgcccggacaacatacgtccttcctccccgtcccccttcgacaacgtaaacaccaagtacaggtaatacttaactcgttccatcactaccgtcctttcgcctcgcgttacggggtcactccaccctcgaccccgtattaacgtggacacggtacccttggtctcggcgaggtcggtctttcacccgtctttatcgtttacttntcgtctacgtctagtttccgacttacgtttctacgtaccttacccgtccaaggtacctagtccgcccttaccgaaccgtacgaccctaacctaaccccgttcaaccggtacggtacccttaaaccgaaccggtaaccccgttcccctaaaccccccgtaaaccaaaccgtaaacccgccgtaaacgttaaccggtccggtaccgccgttcggaccccgtcgtacggttacccgtttcgggtaccgttacttaccgggtttacccggttttaacccggttcccccggtttaccctttaaccgtccccgttttaccccgggaccttaccgtttaaccggttaacggtaaaccgggtttaacccggtaacttacccggg

SEQ ID NO: 102072 - DNA, 757 bp, Homo sapiens
  misc_feature: GYAE6OF01AFIOE.9.33.C11.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (293)..(293): a, c, t, g, unknown or other
  misc_feature (293)..(293): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattggtgttgacacagtctccagccaccctgtctttgctccgaggggaancgccacctntcctgcaggccagtcagngtcgtaccaccgagttagccgtggtaccaacgacaaacctggccaggcctcccaggcccctnactcttgactgcatccatcgagggcctacgtggctactcccagtcccgaggttccaggttcggctaacggttcggggtcttcggggactacggtacctttccaccttcgtaccacctaacttccgacgtcgaacgtcccgtaagtacggtccgttaggaacgtttacgtttttacggaccgtttaaggtttttacgttaacgttcggttaacctaaccgtaacgtttacccggttaaccggtacgggttcccggggtaccccggtttcccgggggggtaccccttaccggtttttacccggggtaccccggtttacggggtaacccgttaaaacggtttcgggaacgttaacgtaccgtaaaaacccgggtacgttacgggttacgggtaccgttacggccctaacccgtactttccgttaccgttcccgttaaccgtccgtttccccgttccccggtaacccg

SEQ ID NO: 102073 - DNA, 827 bp, Homo sapiens
  misc_feature: GYAE6OF01AZY3T.9.33.C11.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
tcagtgatacgtctcacgaccggtgctcgatttagagtgagctcgttgggtttgggggaggaactgctcagttaggacccagagggaaccatggaacgccccagctcagcttctcttcctcctgtctactctggcctccagactaccgacggagagtattgtgtgacacgagtcctccgacgccctacctgttcctttgccgtaccggaaagggaaacnccgcccctacctctccgtcgacgacggccagtcagtacgttcgtacccacgtaggtcnccgtacggaacctaacgaacctaaccgtcggacgtacggtcccgacccgaccggtcccctagtactttcgtttagacttcggacctacctaccgtcgtaccggaccggtacccgacgtaccggtccctaccttaccccggacggtaccgtacgggttataaccggttcggtaccggtagggttcggtacggtccggaactacgggttacctttaccggaccttaccgacctaaccgtgtaccacggtacgtacggtacgtacggtacgttaacgtagtaacgtttacgtttacgtacgttttaacgttacgttaccgtactaaccgttaaacgtccggttaaccgtccggtaacgggttacccgggtccccgggtttaacccggttcgtaacccccggtttccggggaaccggttaaacggttaaactaacggtgttaaacaaccgttaaacgtaacggtaacgttgggtaccccttaggaacccttccgaactttaccgtccgttaccggttaccgtttaccgcccttttaacccggaccgttaacccg

SEQ ID NO: 102074 - DNA, 941 bp, Homo sapiens
  misc_feature: GYAE6OF01BWSIL.9.33.C11.1.454.CMB.1.raw
  modified_base (222)..(222): a, c, t, g, unknown or other
  misc_feature (222)..(222): n is a, c, g, or t
tcagtgatacgtctcacgaccggtgctcgatttagagtgagctcgttgggttttcctcgttgctcttttaagaggtgtccagtgtcaagtgcaactggtggagtcgtggggggggctggtccagcctgggacgtccctgagctcctcctgtgcaggctcgtggtacttccaccctttcgaaggttaacctaccgggcgttcgaccgacggttcggggtcccnccgacggccctccggaagggaccgaaaggggtccgttagggacgttcgggaccttggggccttaggttttcgttaccgagttacgtagggtaaaggtacgtttcgtaacctaaagttaacttaacgtaacgaacggtaccgttacccggtaggaaaccgggtccgttaacttaccgacctactaccgtaccccgaaggtaaccgtaaccttaaacgttaaccccgaaaacggtaacctaacgtaacgttacggttaacttccgtaagaaccgtaaaagttcggaacgtaaccgtaaccggtaaagtaggtaacggaacggtaaccgtacggtacgtttaagtttaacgttaacggtaacggtaaacggtaaagggtacggggtaatacggagtcggacctaggaccttaacgtaaacgttcgtttaacgttcggtaaccggttcgggtacggggtaacctaaccgggtacccgtttaccggtaccgttaaccccgttcccgttaaccctacggtacccgtaccccgtaaccccggtaaacccggtaacccgggttcccctttaacgttcccccgggttacccccggtttacccccggacgggttccccccgttcccgttaccggtaccccgtacccggggtaacgccccgttaaaccccgccccggttaaacggccggaacccgccgaaaccggtcccgggacccgtccgtacccgggg

SEQ ID NO: 102075 - DNA, 736 bp, Homo sapiens
  misc_feature: GYAE6OF01EE7A7.9.33.C11.1.454.CMB.1.raw
  modified_base (607)..(607): a, c, t, g, unknown or other
  misc_feature (607)..(607): n is a, c, g, or t
  modified_base (615)..(615): a, c, t, g, unknown or other
  misc_feature (615)..(615): n is a, c, g, or t
tcagtgatacgtctcacgaccggtgctcgatttagagtgagctcgttgggtttcctcgttgctctttaagaggtgtccagtgtcaagtgcaacgtggtggagtcggtggggggggcgtggtccagccgtggggacggtccctgagactcctcctggtgcgaggcttcgtggtacttccaccctttcaaggttaacgtccggcgtgccgtacgtgggtcccgccgacggctaccgaggcgaagggtcttggaggtgccgtagggtctaggttttctttacattcgtaggtaaggtaacgttgttacaaattacgtatacgacgtacgtaccggtaggaacgggtacctagttaccaacctattacctacgaagaacgaactaactaacctaaacgaactaaccgtaatctatacgtataacgaatacggacagtaacgtaagtacgtgaacgaccgtaggtacttagtttaagtacgtaaggtaaacgggaaaggggagggtaatacggtacggtggactacggcctaacgtaaacggtacctttacgttacgtaccgttcggtacccgggtacgtaaccgggtacccgtagttacccgaccgttccnccgtaacncccgacctaccccgaacggtaccgccccgtgttcccgtcccccgtccgaccgcctccgtacgtccgacgcggacctccgacctaaccgggccacggaccaacggcccggtccgcggtcggg

SEQ ID NO: 102076 - DNA, 694 bp, Homo sapiens
  misc_feature: GYAE6OF01CBVMP.9.33.C11.1.454.CMB.1.raw
  modified_base (142)..(142): a, c, t, g, unknown or other
  misc_feature (142)..(142): n is a, c, g, or t
  modified_base (178)..(178): a, c, t, g, unknown or other
  misc_feature (178)..(178): n is a, c, g, or t
  modified_base (211)..(211): a, c, t, g, unknown or other
  misc_feature (211)..(211): n is a, c, g, or t
  modified_base (348)..(348): a, c, t, g, unknown or other
  misc_feature (348)..(348): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
  modified_base (488)..(488): a, c, t, g, unknown or other
  misc_feature (488)..(488): n is a, c, g, or t
  modified_base (579)..(579): a, c, t, g, unknown or other
  misc_feature (579)..(579): n is a, c, g, or t
tcagtgatacgtctcacgaccggtgctcgatttagagtgagctcgtggggagaggagcccagcacgtagaaggtcggcggtgtttccattcggtgatcagccacgtgaacacagaggacctcaccagtggagtttcggctgngtcgttgggttttcctcgttgtcgtttctttaaggnggtgtccagtcgtacaagtgacacgtgggtggnggtcgggtgggggggtctcggtccgagccgtgggacgttccctggaacgtctcgtctggtcgcgtaggtcttcgtcggtacttaccgacctttacaacggttaaccgtcggccgttaggcctacggtccgggacccnccggaggcccgtaccggacggtacgtacgggtcttggggactcggacgtggtcgtagttgttccagttcgaggtaacgtntcgtaacatacgtanacgtacgtacgtcggagtaccggcttaactcacctactcacgaancgtaactaacgtaccaaacgacgtacgtacgtgtacgtacgagacgtaacgtcgaactaacgattacggaagttcgaacgtacgacgtttntaagtttacgaacggttcgaaagggtaggaggggtaactacgggtagggtacgaacccgtgtaccgtaacgtttacggaacgtttaccggtacttccgggtacggttaacccggg

SEQ ID NO: 102077 - DNA, 897 bp, Homo sapiens
  misc_feature: GYAE6OF01ADQRQ.9.33.C11.1.454.CMB.1.raw
  modified_base (319)..(319): a, c, t, g, unknown or other
  misc_feature (319)..(319): n is a, c, g, or t
  modified_base (509)..(509): a, c, t, g, unknown or other
  misc_feature (509)..(509): n is a, c, g, or t
tcagtgatacgtctcacgaccggtgctcgatttagagtgagctcgtgggagaggagcccagcactagaagtcggcggtgtttccattcggtgatcagcactgaacacagagacctcaccagtggtagtttgggctggacgtcgttcgggttttccctcgttgtccttacgttttaaaggaggttcgtacctaggtgtacaaggtgacctaacggtgggtagggacggtcgggtggggggggccttggccgaacggtccggtgggaccggttcccaggaccggtacttccgtaccgtggtacgacgtacgggtcttacgnggtaccttacccgtacccgttagaacgttaaccggccggtacgtaccgaccgtaccggtccggggccctaccgaggtaccccgtaccggaacgggtaaccgtaacgggtcgttagggacggttcggtccgtaggtacgttaaggtttcgttactacggttaggtaacggaacggtttaacggctttaaanaaccgttacgtaacgttaaccgacgttaaccggtcggtaaacgggtaccgtccgtaacgttacccgaaccttacgtacccgtaacccgaaaggtacctaaacccgtttaaccggtaaacgaaaccggtaacccggtaacgttaacgtttagtaaaccccgtttcgaaaacgggttaaacctaaggggttaccgaaccttaacggaacgttaaggtacgggtaagaaccggtacgttaccggtaacttttaggttaacgtaaccggtagggtaaaacgggaacggggagggttaaacaccgggttgaaaccgggttaccggtaacctagggttaaaccttaaccggtttagttaaccgtttacccgggtaagttcccgggtaaacgggg

SEQ ID NO: 102078 - DNA, 834 bp, Homo sapiens
  misc_feature: GYAE6OF01C6ZI8.9.33.C11.1.454.CMB.1.raw
  modified_base (211)..(211): a, c, t, g, unknown or other
  misc_feature (211)..(211): n is a, c, g, or t
tcagtgatacgtctcacgaccggtgctcgatttagagtgagctcgttgggtttgggggaggaactgctcagttaggacccagagggaaccatggaacgccccagctcagcttctcttcctcctgctactctggctcccagatacccaccggagagtattgtgttgactacagtctccagccacccttgtctttgtctccgaaggggaaacncgccaccctctcctgcaggccagtcaagtagttacgttacccaccagttacgccgttacgtaccaacaacaaacccgtggacccacggcctccccgaacggtcccctatacttcctttagacttggactacgtaccagtcgacggaccctacgtggccacgtacccgaagtccgtacggttcgaggtcgacgtacggtgggtctaggggactacgttaccgttaccaccgttacctaccgtaaccactaccgagtaacccgtacggtaaccgttaacgggacccgttaacccgttagggttaaaaacgttggttttttaccggaaacgttttaaacgttttacgttaaccgtttacgtaaccgtaaaccttaccgggtttaaccggtaacccgggtacgggttacccgggggtacccccggtttaacccgggggtaccccctttaaccgggttttacccgggaccccggttaacggggtaaaacccttaaaggtttcgggaaactaccgtaaaacgtaacccggtaacgttcgggtaccgtaccggtttaccgaacgtaacccccgttagttaccgttaccgttaacctttcccggttaacctcccgtttaacccccgtacgg

SEQ ID NO: 102079 - DNA, 801 bp, Homo sapiens
  misc_feature: GYAE6OF01AZJ9G.9.33.C11.1.454.CMB.1.raw
  modified_base (750)..(750): a, c, t, g, unknown or other
  misc_feature (750)..(750): n is a, c, g, or t
  modified_base (781)..(781): a, c, t, g, unknown or other
  misc_feature (781)..(781): n is a, c, g, or t
tcagtgatacgtctcacgaccggtgctcgatttagagtgagctcggttgggttgggggaggaactgctcagttaggacccagagggaaccatggaacgccccagctcagcttctcttcctcctgctactctggcctcccagatacccaccgggagagtcttgtgttacgacacgagtctccaagttccacccgttgtccttttacgtccgtaccgaaggggggtaaactacggcccctaacccctcgtccctggccgaacggggtccccaggttaccaagggtagttccgttaacccccgaacccgttacggttaacggtccccgttaccggggttaaaccccaaaacctaacccgtaaaaacccgtccgggacccgtaaacgggcccttaccccggaacccggggtccccccttacgaacttttccgtttacgacgttcggacctactcccgtatccgacgggtccacgttgggcctacctcccgaggtccgacgttcagggttcaccgtgggttccgggtcgtacgggacgaagttacgtttccgaccgtacctacaccgacgttcgacgtcaacgtctaacggcgacctaggtagttacgttcgtaccttagtttactacttcggtaaccaacgttacgttaccgaccggttacgccgggtacccgggttcccgggcttaccgggttccacccggttacgggtaacttaacgtggaactagtaaccggtaaacgcgtacgtccggtntacgtcctaccgtagttcttacgtccttaancccgtttacctcccgtaacg

SEQ ID NO: 102080 - DNA, 928 bp, Homo sapiens
  misc_feature: GYAE6OF01CYCCQ.9.33.C11.1.454.CMB.1.raw
tcagtgatacgtctcacgaccggtgctcgatttagagtgagctcgtgggagaggacgcccagcactagaaggtcgggcggttgtttcctattcggtgatcagcactgaacacagaggactcacatggtaggttggctgagtcgttcgggttttcctcgttgtctttacgtttaaggtagggttcgtacctaggtgtacgtaaggtcgtacgtaacggttggggtgggtacgggtcgggggtggggggggtcggtcgggtaccgacgggtccggtcggggtacggttcccgtaggtacgtaccttccgttccggttcggtcggaccggtacgggtcttcggttacggttacctttccctaacccgttacgtaaccggttaaccggtaccgggtcgtacgaccggtccgggtaccgggtcccgccggacggtcccgtaccgggagggaccggtacgggtcgttgggtacgggtcggtcggtacggtcggttacggtttacgttacgtaggttacgtaagggttaacggttacgtttacgttaaacttaaacgtaacttaacgtacgtaacggtaccgttacgggtaacgggtaccgggtacctacgttacctaacccgtacgttacccgtaacgaaacggtaacctaaacgtaacccgttaaacgaaacggtaaccgtaacggttaagttacgttaaccgttaacggtacgtaaaacggttaggtaaccgaacggttaacgtaacggttaaacggggtacggtaccgggtaacggtaaaccggtttaggttaacgttttaacgtttacgggtaaacgggttaaaggggtaacgggtaaagggggtaaccggtaataccgggtaagggtccgtaacgacggttaccttaaaggttaccgttacttagggtcctagggttacggtacccggg

SEQ ID NO: 102081 - DNA, 848 bp, Homo sapiens
  misc_feature: GYAE6OF01BCC1C.9.33.C11.1.454.CMB.1.raw
tcagtgatacgtctcacgaccggtgctcgatttagagtgagctcgtttgggtttgggggaggaactgctcagttaggacccagagggaaccatggaacgccccagctcagcttctcttcctcctgctactctggctctcagataccacggagagattgtgttgacacagtctccacgccaccctgttctttgtcctaccgaaggggaaagacgcccaccctctcctgcgacgggccagtcagtacgttcgttaacccacccgtagttacgccgtacggtaacccaaaccaaccgaaacccgtcggacccacgggccctaccccgaaccggtccccttactacttcgtttcgattcggacctactccctagtccggaacgggccctacgtcggacctaccgtcccgacgaccgttaggttacgtacggtcgggcgtaggggtcggtcggtacgggactacggttaccttccgtacttcctacgaaccctacgtaccgaacggacctaccggtacccttaacgggtaccgtacccgttaaagggttaaacgtttacgttttacggtaaacgttttaacggtttttaactttaccgttaacgttaacctaaacgttaccggtttaaccggtaccgggaaccgggtttcccggggtacccccggggttacccggggggttaacccctttaaccggggtttcccccgggtaacccgggttaaaccgggtaaacccgttaaacggttacggaacgtaaccgttaaaccggtaaaacggttaacgtcggttacggtaccgtacaccgtacccttgtttaccgttacgtttactaccgttaccgttcccgtacccg

SEQ ID NO: 102082 - DNA, 845 bp, Homo sapiens
  misc_feature: GYAE6OF01EJV7H.9.33.C11.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
tcagtgatacgtctcacgaccggtgctcgatttagagtgagctcggttgggttgggggaggaactgctcagttaggacccagagggaaccatggaagccccagctcagcttctcttcctcctgctactctggcctccagataccaccgganagattgtgttgacacagtctcagccacctgtcttgctcgagggaangccacctctcctgcagggccagtcagactcgtaccaccagttagcctaggaacctaacgactaaacctggaccaggcctccgacgccctacatccttgactgactatccacgtacgacggaccacgtaggcacgtcccaacgtccgtaacggttaccgtaggtcgggaccgtaggtacggggttactacgggggaacctagggtaacctttaccgaaccgttaccgttaccccgtaacccgtaacgttacccggaacggtacccgtaacggtacccggttaacggtaaccggtaccgttaacgggttaaacgttaacgttttaccgtaacgtttaacggtttttaaacgtttaaccgttaacgtttaaccgtaaaccgtaacggttacccggttaacccgggttaacgggttaccggggtaccccggtttaccccgggggggtacccttacccgggttttacccgggtaccccgggttaaccggggttaaacccttaaaacggttaccggtaaacggtaacggttaaaccgaaaaccggttaaaccgttacgggtaaccggttaaccggtaacggacccgttaaccgtaactaccggtttaacgttacccgtttaaccgtaccgtttccccgttaccccggtaacccg

SEQ ID NO: 102083 - DNA, 786 bp, Homo sapiens
  misc_feature: GYAE6OF01EOQKO.9.33.C11.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccgggagagattgtgttgacacagtctccagccaccctgtctttgctccgaaggggaanagcccaccctntcctgcgagggccagtcagagttgttacccacctagttacgcctaggtaacccaaactaccaaaaccgtggcccaagggccctaccccaggccccctcattccttttggacttgactaacttccgaattccggacggggccctaacgtcgggacctaactccccgaagtccccgtaagggtttccagggttcggaccgtagggttcggggtaccgtagggggaactacggtaacctttccaacgttccttaccaaccctagtaccgagtccaacgtacctaggacgtccgtagtaacgttattttacgacgttagttttacttagttacgtacctaaacgtacgttaccggtaaccggtacggtacgggtaccccgggtacccgggggtaccttacccgggtttcccgggtaccccggttaacggggtaaacccttaaaaggtttacggaaccggtaacgttaaccgtaaaaccggtaacgtacgggttacggtaccgttacggacccgtaacgtacgtttccgttacgttaccctttaccgtttaacccgttttccccgaccgttaaccg

SEQ ID NO: 102084 - DNA, 775 bp, Homo sapiens
  misc_feature: GYAE6OF01AU2V5.9.33.C11.1.454.CMB.1.raw
  modified_base (75)..(75): a, c, t, g, unknown or other
  misc_feature (75)..(75): n is a, c, g, or t
  modified_base (167)..(167): a, c, t, g, unknown or other
  misc_feature (167)..(167): n is a, c, g, or t
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (433)..(433): a, c, t, g, unknown or other
  misc_feature (433)..(433): n is a, c, g, or t
tcagtgatacgtctcacgaccggtgctcgatttagagtgagctcgtgggagaggagcccagcactagaagtcggnggtgttccattcggtgatcagcactgaacacagaggactcaccagtggagtttgggctgagtcgtggttttcctcgttagtcttctttaagnggttgtccagtagtcaagtgccgtaacgtggtggtaggtcgggtcggggggtcgtgccgngccggaggggtcggtcccgaggtctaccttcctcgtcggtcgccgtaggtccgttgtacggtcttccgtaccttaacgtacggtaactaccgggtnttccgcgcgttcggaccncgtagcctcgaggcgaacggtcgtaggtgtcggctacggtcgttgtttacgtctaggtcgtaaggtacgtacgttgtaacgtaatacgttanacgtacgacgttcggacggtaaaccggtctacgtaccgactacgtacctagaacgtaaccgaaccgttaaacttaacccggtaaaacgacgtaacgtaacccgttacgttaacggttacccgtacgtaaacgaaccggtaacggtaaccgtaaacgttacggtaacgtaacggtaggtaaccggtccgtaagggttcctttaagggtacttaacgggttaacggaaccgggtttaggtaacgggggaagttccggtagtaacgggtcgtaacccgtaacccggttacgtttacgttaacccggtttagttaaccccggttgggttaacggttaaacccgggg

SEQ ID NO: 102085 - DNA, 905 bp, Homo sapiens
  misc_feature: GYAE6OF01CW1NJ.9.33.C11.1.454.CMB.1.raw
tcagtgatacgtctcacgaccggtgctcgatttagagtgagctcgtgggagaggacgcccagcactagaaggtcggcggttgtttccagttcggtgatcgagcactagaacacagacgacctcaccagtggtaggttggctgagtcgtttcgggttttcctcgttgtctttacgtttaaggaggtctcgtagtgtacagtcgacgtacggtgggtgggtacggtcggggtggggggtctcggtacccgacggtccggtaggggtaccgtcccgtaggtaccgtaccttccgttccggtggtacggacgacggttctcgttacgtaccttaccgtaccgtaacgtaacggtaccgtccggcgtacgaccgtcggtaccggtcccgaccgacggtacccgtacggacgacggtacggtcgtaggtcggtcgtcgtcgtacgtttcgttcgtaccgagttacggtaagtaacggtagtttacgtaattaaacgtaaccttacggtaaccgtcggtaacccggttacggaaacgggtacgtaccgttacctacccgaacgttacgttaccgacgtaaacgtaccgttaaacgaaccgttaaccgaaaccgtttaacgaacgtttaccgttaacgttagtaacccgttaagaacgtaaaccggtagtacccgtaagtaacggttacggtaaggttaaccgggtaacggttaccgttacggtttaaacgtttttcgttaaaggtttaacccgggttaaaggggaaaccggggtaaaagggggtttacggaacccgttaaggggtaaccgggttacggaaaccgtttaaccccggttagttaaaccggttttaaacccggttacttttacccggggtttaaccgtaccggggttttaccccggggaaccggg

SEQ ID NO: 102086 - DNA, 553 bp, Homo sapiens
  misc_feature: GYAE6OF02IWOGF.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaagagccaccctctcctgcagggccagtcagagtgttaccacccagttacgcctggtaccaacacaaacctggccaggctcccacggcccctcatctttgatgcatccatccgagggccacgtggcactcccagcctaggttcagtggcaggtgggtctgggacagacttcactctacacatcagcagcctagacgcctagaagtatttgcttagtttatactgttacaactatcgtacgagtcggccgtccggggcctacgtttccggccgtcgggaacctaaagtgaagtactacaacgtacgtaggtcggtactgacaccgtatctcgttcttctacttcctcccgtacc

SEQ ID NO: 102087 - DNA, 561 bp, Homo sapiens
  misc_feature: GYAE6OF02JZMLV.9.33.C11.1.454.CMB.1.raw
  modified_base (289)..(289): a, c, t, g, unknown or other
  misc_feature (289)..(289): n is a, c, g, or t
  modified_base (383)..(383): a, c, t, g, unknown or other
  misc_feature (383)..(383): n is a, c, g, or t
tcagtgatacgtctcacgaccggtgctcgatttagagtgagctcgttgggtttgggggaggaacgtgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctccaggccctnatcttgatgcatccatcaggccactggcatcccagccaggttcagtgcagtggtctgggacagacttcactctacaccatcatcagcctagacncctgaagatttgctagtttatactgtcagcagtgtacgcaacttggacctcggaaccgttcggaccgaaagggtaccaaaacggtcggtaaccaagtacgtaaggaccggaaccgttaggtgggtaccgttacggaccaccgtaacgttaccgttcgtaccgttttcgaactttcccg

SEQ ID NO: 102088 - DNA, 529 bp, Homo sapiens
  misc_feature: GYAE6OF02GP22G.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctcccaggcccctcatcttgatgcatccatcagggccacgtggcatcccagccaggttcagtggcaggtgggtctgggacagacttcactctcaccatcagcagcctagacgcctgaagtatttgctagtttattactgtacaactatcgtacgagtcggccgtccggggcctaccgtttcggcccgtaggaacctaaagttcgaagatacaacgactggtggctcgcaccatctgtcttcattcctcccgtc

SEQ ID NO: 102089 - DNA, 520 bp, Homo sapiens
  misc_feature: GYAE6OF02IMSFC.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttggggtttggggaggaactgctcagttaggacccagagggaaccatggaagccccagctcagcttctcttcctcctcgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctacccaggcccctcatcctttgatgcatccatcagggccactggcatcccagccagttcagtgcagtggctgggacagacttcactctcacatcagcagcctagacgcctgaagtatttgctagtttattactgtcaacatcgtaccgagtgccgtccggggcctacgttcggccctgggaacctaaattgaacgatacaacgaactgtcggactgcaccatctcgtcttcactctccgtcc

SEQ ID NO: 102090 - DNA, 531 bp, Homo sapiens
  misc_feature: GYAE6OF02HKGJP.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctcatctttgatgcatccatcagggccactggcatcccagccaggttcagtggcaggtgggtctgggacagacttcactctcaccatcagcagcctagacgcctgaagtattttgctagtttattactgttacaacatcgtaccgagtcggccgtccgggggcctaccgtttccggcccgtcgggaacctaaagttgaagactacaacgaactgtggctgcaccatctgtcttcactctcccgc

SEQ ID NO: 102091 - DNA, 541 bp, Homo sapiens
  misc_feature: GYAE6OF02IYL5S.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgtaccacccagttagcctggtaccaacacaaacctggccaggctcccaggcccctcatcttgatgcatccatcagggccactggcatcccagccaggttcagtggcaggtgggtctgggacagtacttcactctcaccatcagcagcctagacgcctagaagtatttgctagtttattactgtacaactacttacgtaccgtagtcggtccgtccgggggtcctacgtttcggcccgtacgggaacctaaagttgaagactacaacgactaggtgactgcaccatctcgtcttcactcctcccgtcc

SEQ ID NO: 102092 - DNA, 514 bp, Homo sapiens
  misc_feature: GYAE6OF02IIR10.9.33.C11.1.454.CMB.1.raw
  modified_base (504)..(504): a, c, t, g, unknown or other
  misc_feature (504)..(504): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagacgcctgaagtatttgctagtttattactgttcaacatcgtacgagtggccgtccggggcacgttcggcctgggaccaaagttgagatacgaacgactgtggctgcaccatctgtcttnatcctcccgc

SEQ ID NO: 102093 - DNA, 561 bp, Homo sapiens
  misc_feature: GYAE6OF02ILWI5.9.33.C11.1.454.CMB.1.raw
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
tcagtgatacgtctcacgaccggtgctcgatttagagtgagctcggttgggtttggggtacgatttgatgttacctgatgcttagaggcttttcctggaagcagggcatttgttgcttccagcaccgtagtgcctcgtcatcacgcctcagccttgattttccggatttgcctggaaaaccagcctacccgcttaaaccgggacaaccgtcgcccggccaacatagccttctccgtcccccttgccagtaacaccaagtacaggaatattaacctgtttcccatcgactacgcctttcggcctcgccttagggtcactcaccctgccccgataacgttggacaggaacccttggtcttccggcgagcgggcttttcacccgctttatcgttacttatgtctacgcattcgcacttctgatacctccagcatgcctcacagcacaccttcacaggcttacagaacgctccctacccaacaacgcataagctacgctgccgnagcttcggtgcatggtttacnccccgtttcactcttcccgccatcctgaagtaccgtatcc

SEQ ID NO: 102094 - DNA, 519 bp, Homo sapiens
  misc_feature: GYAE6OF02GTI5X.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccagttcagtggcagtgggtctgggacagacttcactctcacatcagcagcctagacgcctgaagtatttgctagtttatactgtacaacatcgtacgagtcggccgtccggggcctacgttcgccgtggacctaaagttgaagatacaacgactgtgctgcacatctcgttcttcacttcctcccgtacc

SEQ ID NO: 102095 - DNA, 561 bp, Homo sapiens
  misc_feature: GYAE6OF02JAGRD.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctcccaggcccctcattctttgatgcatccatcgaggccactggcatcccagccaggttcagtgcagtgggtctgggacagacttcactctacaccatcagcagcctagacgctagaagtatttgactagtttattacttgttactaactacttacgtaccgtagtcgggcccgttccggggcctaccgtttccggcccgttacgggaacctaaagttcgaacgtactacaacgtaacgtgtggactgaccactagtcttgtccttactacttccttcccgtacc

SEQ ID NO: 102096 - DNA, 576 bp, Homo sapiens
  misc_feature: GYAE6OF02GVFS7.9.33.C11.1.454.CMB.1.raw
  modified_base (357)..(357): a, c, t, g, unknown or other
  misc_feature (357)..(357): n is a, c, g, or t
  modified_base (536)..(536): a, c, t, g, unknown or other
  misc_feature (536)..(536): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtgacaggaccttggctccggngagcggcttttcaccgctttatcgttacttatgtcagcatttcgctacttctgatacctccagcatgcctcacagcacaccttcacaggcttacacgaaccgctacccctaccaacaacgcaataacgcgtcgctcgcccgcacgccttcggcgcagttcggtttaccgccccgttttnacttccttcccgcctactcctaggaacgtaccgtataccg

SEQ ID NO: 102097 - DNA, 512 bp, Homo sapiens
  misc_feature: GYAE6OF02G86W7.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagatttgcagtttattactgttcaacatcgtacgagtggcctccggggccacgtttcggccctgggaccaaaatgagatacaacgaactgtggctgcaccatctgtcttcatctcccgcc

SEQ ID NO: 102098 - DNA, 639 bp, Homo sapiens
  misc_feature: GYAE6OF02I567G.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctccagataccaccggagagattgtgttgacacagtctccagccacctgtctttgtctccgaggggaaangcccaccctctcctgcagggccagtcagagtcgttaaccaccagttacgcctggtaaccaacacaaacctggaccaggcctccacggcccctcattctttgatcgcactaccatcgacgggcccacgtcggcactcccagccgaggttcagtcggctaggtgggtcgtgggacacggtacttcactctcaccatcgagcacgcctaagcgactgaagtagtttgtactaagtttacttactcgtactaactacttaccgtaccgtaggtaccggtacccggttccggggaccttaccggtttccgggccgttacggggaacctaaaggttacgaacgtactaaccgaaacggtacgtacggtcggtaccttacgaccgtaacctagttccgtttacgttaccgtttacctaaccgtttcccgttaccccgtaaccg

SEQ ID NO: 102099 - DNA, 539 bp, Homo sapiens
  misc_feature: GYAE6OF02GP3NR.9.33.C11.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctnatcttgatgcatccatcagggccactggcatcccagccaggttcagtgcagtgggtctgggacagacttcactctcaccatcagcagcctagagcctgaagtatttgctagtttattactgttacaactatcgtaccgagtcggccgtccggggcctacgtttccggcccgtacgggaacctaaagttcgaagtactacaacgactaggtggctgaccaccatctcgtcttctacttccttcccgtacc

SEQ ID NO: 102100 - DNA, 541 bp, Homo sapiens
  misc_feature: GYAE6OF02JJ4A4.9.33.C11.1.454.CMB.1.raw
  modified_base (292)..(292): a, c, t, g, unknown or other
  misc_feature (292)..(292): n is a, c, g, or t
  modified_base (367)..(367): a, c, t, g, unknown or other
  misc_feature (367)..(367): n is a, c, g, or t
tcagtgatacgtctcacgaccggtgctcgatttagagtgagctcgttgggtttgggggagggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatctttgatgcatccatcaggccactggcatcccagccaggttcagtggcagtgggctgggacagacttcactcncaccatcagcagcctagacgcctagaagtatttgctagtttattactgtacaactatcgtacgagtcggccgtccggggcctacgtttccggcccgtacgggacctaaagttcgagtactacgaacgtacgtcggtggctgaccacatctgtccttactactccttcccgtacc

SEQ ID NO: 102101 - DNA, 565 bp, Homo sapiens
  misc_feature: GYAE6OF02IK6C7.9.33.C11.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtgagctcgttggggtttggggggaggaactgctcagttacggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttacgcctggtaaccaacacaaacctggccaggcctcccaggccccctcattctttgatgcatccatcagggccactggcatcccagccaggttcagtggcagtgggctgggacagacttcactctcaccatcagcagcctagacgcctagaagtatttgctagtttattactgtactaactactaccgtaccgagtcggcccgtccggggcctaccgtttccggcccgtacgggaacctaaaagttcgaacgtactacgaacgaacgtcggtggactcgaccaccattctcgttccttctacttcctcccgtacc

SEQ ID NO: 102102 - DNA, 543 bp, Homo sapiens
  misc_feature: GYAE6OF02IVE4X.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggcctcccaggcccctcatctttgatgcatccatcgagggccactggcactcccagccaggttcagtcggcaggtgggtctgggacagacttcactctcaccatcagcacgcctagacgcctagaagtatttgacttagtttattactgtactaactactacgtacgtagtcggccgtccggggtcctacgttccggccgtacggaacctaagtcgagactacgaacgtacgtgtcgctcgactacatctgtcttctacttcctcctac

SEQ ID NO: 102103 - DNA, 523 bp, Homo sapiens
  misc_feature: GYAE6OF02F12VN.9.33.C11.1.454.CMB.1.raw
  modified_base (392)..(392): a, c, t, g, unknown or other
  misc_feature (392)..(392): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctcatctttgatgcatccatcagggccactggcatcccagccaggttcagtggcagtgggtctgggacaggacttcactctcaccatcagcagcctagagccngaagtatttgctagtttatacttgtacaactatcgtacgagtggccgtccggggcctacgtttccgccctagggaccaaagtgagatacaacgactgtggctcgcacatctcgtcttcacttcctcccgcc

SEQ ID NO: 102104 - DNA, 529 bp, Homo sapiens
  misc_feature: GYAE6OF02HMSSD.9.33.C11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctntcctgcagggccagtcagagtgttaccaccagttagcctggtaccaacacaaacctggccaggctcccaggcccctcatcttgatgcatccatcagggccactggcatcccagccaggttcagtgcagtgggtctgggacagacttcactctcaccatccagcagcctagacgcctaggaagtattttgctagtttattactgttacaactatcgtacgtagtcggccgtccggggtcctacgtttccggcccgtcgggacctaaagttcgagtagtacaacgactggtgctgcacatcgtgtcttctactctccgc

SEQ ID NO: 102105 - DNA, 562 bp, Homo sapiens
  misc_feature: GYAE6OF02HWVT0.9.33.C11.1.454.CMB.1.raw
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtgcagtgggtctgggacagacttcactcncaccntcagcagctagacgcctagaagtatttgactagtttattactgtactaacattacgtaccgtagtcggccgttcccgggggtacctaccgtttccgggtcccgtacgggaacctaaagttagaagtactaccgaacgtaacgtaggtggcgtgccaccagttctcgttccttctacttccttcccgtacc

SEQ ID NO: 102106 - DNA, 548 bp, Homo sapiens
  misc_feature: GYAE6OF02IIJYH.9.33.C11.1.454.CMB.1.raw
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccctagttagcctggtaccaacaacaaacctggccaggcctcccaggcccctcatctttgatgcatccatcgagggccacgtggcactcccagccaggttcagtggcaggtgggtctgggacagtacttcacttctacaccatcagcagcctagacgcctagaagtattttgctagttttattactgtacaactataccgtaccgaggtcgggccgtccggggacctcgtttccggcccgtacgggaacctaaagtgaagatacaacgactggtggctgcacatctgttcttctacttcctccgcc

SEQ ID NO: 102107 - DNA, 528 bp, Homo sapiens
  misc_feature: GYAE6OF02GQU8M.9.33.C11.1.454.CMB.1.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccacctctcctgcagggccagtcagagtgttaccacccagttagcctggtaccaacacaaacctggccaggctcccaggcccctnatcttgatgcatccatcaggccacgtggcatcccagccaggttcagtggcagtgggtctgggacagacttnactctcaccatcagcagcctagacgcctagagtatttgctagtttattactgtacaactatcgtaccgtagtcggccgtccggggcctacgttccggccctagggaccaaagttgaagatacaacgaactggtggctgacacctatctgtcttcattccttccctcc

SEQ ID NO: 102108 - DNA, 533 bp, Homo sapiens
  misc_feature: GYAE6OF02H4M5A.9.33.C11.1.454.CMB.1.raw
  modified_base (205)..(205): a, c, t, g, unknown or other
  misc_feature (205)..(205): n is a, c, g, or t
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaangccaccctctcctgcagggccagtcagagtgttaccacccagttagcctggtacccaacacaaacctggccaggcctcccaggccccctcatcctttgatgcatccatcagggccactggcatcccagccaggttcagtggcaggtgggtctgggacagacttcactctacaccatcagcagcctagacgcctagaagtatttgcttagtttattactgttacaactatcgtacgagtcggccgtccggggacctcgttccgccgtcggacctaaagtgagatacaacgacgtgnggtctgctacatctcgtcttctntcctcctacc

SEQ ID NO: 102109 - DNA, 541 bp, Homo sapiens
  misc_feature: GYAE6OF02GXK97.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatcttgatgcatccatcagggccactggcatcccagccaggttcagtggcagtgggtctgggacagacttcactctcacatcagcagcctagacgcctgaagtatttgctagtttattactgtctaacatcgtaccgagtcggccgtccggggcctaccgtttccggccgtacgggaacctaaagttagaagtacgtacgaacgaacgtaggtggctcgctaccatctcgtcttctacttcctccgtacc

SEQ ID NO: 102110 - DNA, 598 bp, Homo sapiens
  misc_feature: GYAE6OF02G3E3S.9.33.C11.1.454.CMB.1.raw
tcagtgatacgtctcacgaccggtgctcgatttagagtgagctcgttgggttttcctcgttgctcttttaagaggtgtccagtgtcaagtgcaactggtggagtcgtgggggggggcgtggtccagcctggggaggtccctgagactctcctgtgcaggctctggattcaccttcagtaactacggcgtgcactgggtccgccaggctccaggcaagggcttgggagtggctggctagttgtttcatctaggaaggaagtgttacaatactatacagactccgtgaagggccgattcaccatctccagagacaattccaagaacacgatgtatctagcaaatggacagacctaaagagttagaggacacggtactgtttaatactgtacgaaagagggggataacgagtggcagctcaagtactatttgacttcgtgggcagggaccctggtcaccgtctcctcgacgtcctccgaaccacgggccctaagtcccggtaccttcccccgtaggccgcccgtcgtcccgtccgaacgggtaccgaccctaacccgttcccgaacggacgaccgaccgacggtcccgggacccgtcgggg

SEQ ID NO: 102111 - DNA, 879 bp, Homo sapiens
  misc_feature: GYAE6OF02GE0IC.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagcacctactctcgcaggcgacgtacacgagtagttacctacccacgttagtcctcgtaccgaaccaacaaacctacggccgacggcgtcccacggaccccgtccatctttgtagtacgtcactaccactacgtacgggaccgacctagggcgactacccgtaccgaccgtacggttaccgtacgtagggtccgtaacggttggggttccggttacggggaacggtacgtaacgtttaccctaccgtaccttacccgtaacccaacgttacgtaacggacctaacgacccggtttacgaaggcccttacggtaaagttaacgttttttcgtcgaacgtttttaaagtttaaccctcgttacgtaaaacctaagtttcccggttaacccgggtaacggttcggggtacccccgggttaccccggggggggttaccccgttaaacccttttttcccggggggtaccccccgttaacggggggttaaaccccgtaaaaaaacgttttttaggaccgggtaaaacgtttaaacccgtaaaaaccgggttaaaacccgtttcggggttacgggggtacccgttaacgggtaccccttaacccgtaaaccgtttcccggtttacgtttacccggtttttaccctaacggtttcccctttttacccccccgggcccttaaaccgg

SEQ ID NO: 102112 - DNA, 580 bp, Homo sapiens
  misc_feature: GYAE6OF02GR6CS.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggctccaggcccctcatctttgatacatccatcagggccactggcatcccagccaggttcagtggcagtggtctgggacagacttcactctcaccatcagcagcctagacgcctagaagtatttgactagtttattactagttacaacatcgtacgagtcggccgtccggggcctaccgtttccggcccgttacgggaacctaaaagttcgaacgtaacgtacgaaaccgtacgtaggtacggtctacgacctaacctacgttcctacggttccttaccgtactttcccgttacccgtaccctacg

SEQ ID NO: 102113 - DNA, 612 bp, Homo sapiens
  misc_feature: GYAE6OF02G8P7Z.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccgggagagattgtgttgacacagtctccagcccaccctgtctttgtctccgaaggggaaagagcccaccctctcctgcagggccagtcagagtcgttacccacccagttacgcccttaggtaacccaacacaaaacctggccaaggcctcccaggccccctcatctttgatgcatccatcagggccactggcatcccagccaggttcagtggcagtgggtctgggacagacttcactctcaccatcacgcacgcctagacgccgtagaacgttatttgacttagtttattactgtacaactatacgtaccgaggtcggtcccgtccgggggccctaccgtttccgggtcccgtacgggtaacctaaagttcgaaggtaactaccgaacgtaaccgtaggtcggaccttaggaccgtaccgtacgttccgttacggttccttacgtaccttccgttcccccggtacc

SEQ ID NO: 102114 - DNA, 581 bp, Homo sapiens
  misc_feature: GYAE6OF02F0GJD.9.33.C11.1.454.CMB.1.raw
  modified_base (205)..(205): a, c, t, g, unknown or other
  misc_feature (205)..(205): n is a, c, g, or t
  modified_base (550)..(550): a, c, t, g, unknown or other
  misc_feature (550)..(550): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagngccaccctctcctgcagggccagtcagagtgttaccaccagttacgcctggtaccaacacaaacctggccaggcctcccacggcccctcattctttgatgcatccatcgagggcccacgtggcactcccagccaggttcaggtggcaggtgggtctgggacaggtaccttcgactctcaccatcgagcagcctagacgcctaggaagttatttcgacttagtttattactgttacaactacgtcgtaaccgtagtcggcccggtccggggacctacgtttccgggcccgttacgggaacctaaagtcgaagtactacgaacgtacgtggtcggctcggacctacntcgttcgttccttactcttccctcccgtacc

SEQ ID NO: 102115 - DNA, 588 bp, Homo sapiens
  misc_feature: GYAE6OF02HQBZQ.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttacccacccagttagcctggtaccaacaccaaacctggccaggcctcccaggcccctcatctttgatgcatccatcgacgggccacgtggcactccccagccaggttcaggtcggcaggtgggtctgggacagtacttcactctcacatcagcacgcctagacgtcctagaagttatttgactagtttattactgtactaactacgttccgtacgaggtccggccggttcccgggggaccttaccggtttccgggcccgtacgggtaacctaaagttggaacgtactacgtaacgacgttaggtcggtaccgtacgaccgaccagttctcgtccttcacttcctcccgtac

SEQ ID NO: 102116 - DNA, 546 bp, Homo sapiens
  misc_feature: GYAE6OF02GIAG0.9.33.C11.1.454.CMB.1.raw
  modified_base (356)..(356): a, c, t, g, unknown or other
  misc_feature (356)..(356): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccagggggaaagagccaccctctcctgcagggccagtcagagtgttaccaccagttagcctggtaccaacacaaacctggccaggctcccaggcccctcatctttgatgcatccatcagggccactggcatcccagccaggttcagtgcagtgggtctgggacngacttcactctcaccatcagcagcctagacgcctgaagtattttgactagtttattactgttacaactatcgtacgtaggtcggtccgtccgggggtcctaccgtttccggcccgtacgggaacctaaagttcgaagtactacaacgactcggtggctcggcaccatctgtcttcacttcctcccgtacc

SEQ ID NO: 102117 - DNA, 570 bp, Homo sapiens
  misc_feature: GYAE6OF02HK3X7.9.33.C11.1.454.CMB.1.raw
  modified_base (290)..(290): a, c, t, g, unknown or other
  misc_feature (290)..(290): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccacctctcctgcagggccagtcagagtgttaccaccagttagcctggtaccaacacaaacctggccaggcctcccaggcccctnatctttgatgcatccatcagggccacgtggcactcccagccaggttcagtggcaggtgggtctgggacaggtacttcactctcaccatcagcagcctagacgctagaagtatttgactagtttattactgttactaactatcgtacgagtcggccgtccggggtacctacgtttccggcccgtacgggaacctaaagttcgaagtactacgaacgtaacgtacggtggacctaggccaccgattccgttcgttaccttctactttcccgttcccgtaccc

SEQ ID NO: 102118 - DNA, 532 bp, Homo sapiens
  misc_feature: GYAE6OF02G2XPJ.9.33.C11.1.454.CMB.1.raw
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcaggtgggtctgggacagacttcactctcacatcagcagcctagacgctagaagtatttgcttagtttattactntacaactatcgtacgngtcggccgtccggggcctacgtttccgccgtagggaacctaaagtgagactacgaacgtactggtggctcgctaccatcttgtcttcacttcctcccgtc

SEQ ID NO: 102119 - DNA, 606 bp, Homo sapiens
  misc_feature: GYAE6OF02G4ZO6.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactactcagttaggacccagagggaaccatggaagccccagctcagcttctcttcctcctgctactctggctcccagataccaccggagagattgtgttgacacagtctcctgccaccctgtctttgtctccaggggaaangccaccctctcctgcagggccagtcagagtgttaccaccagttagcctggtaccaacacaaacctggccaggcctcccaggcccctcatcttgatgcatccatcacgggccacgtggccactcccagcctaggttcagtggcaggtcggtctggggacagtacttcactctaccacatcagccagcctagacgcctagaagtatttgactagtttattacgtgtactaactacttacgtaccgtagtcggtccggtccggggtaccctaccggtttcccgggacccgtacgggaacctaaaagttcggaaacgtaacgtaacgaaaccgtacgtacggtacggcgttacggacctaaccgtacttccgttcgttccttccgtacttcccttacccgcctaacg

SEQ ID NO: 102120 - DNA, 737 bp, Homo sapiens
  misc_feature: GYAE6OF02F267G.9.33.C11.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttaccaccagttacgcctggtaaccaacacaaacctggccaggcctccacggcccctnatctttgatgcatccatcgacgggccacgtggcactcccgagcccgtaggttccaggtcgggcctaggtcggggtcgtagggggaaccaggtacctttccaaccttccgtacctaaccccattccgaacgtccaacgtccgtaaacggacgtacccgttaggtaaagttacgttttacgtacgttaaggtttttaactttaccgttacgttaacctaaacgttacgttaccggttaacccggtaggttaccgggtccccgggttccccggggggtacccttacccggttttcccggggaccccggttacggggtaaacccttaaaaaggttcggaacggtaacgttaaccgaaacggtaacgtacggggtcggacccgttggaaccctacccgtattacccgttacggttcctttacgtaccgtttcccgttccccggtaacccg

SEQ ID NO: 102121 - DNA, 565 bp, Homo sapiens
  misc_feature: GYAE6OF02GGFAW.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccagggggaaagagccaccctctcctgcagggccagtcagagtgttaccaccagttacgcctggtaccaacacaaacctggccaggctcccaggcccctcatctttgatgcatccatcagggccactggcactcccagccaggttcagtggcaggtgggtctgggacaggacttcactctcaccatcagcagcctagacgcctagtaagtatttgacttagtttacttactgttactaactataccgtacgtggtacggtccgtccggggtcctacgtttccggcccgttacgggaacctaaagttcgaacgtacgtaacgaacgtacgtggtggactcgacacctatcgtcgtccttcacttcctcccgtac

SEQ ID NO: 102122 - DNA, 546 bp, Homo sapiens
  misc_feature: GYAE6OF02JE4KT.9.33.C11.1.454.CMB.1.raw
  modified_base (261)..(261): a, c, t, g, unknown or other
  misc_feature (261)..(261): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
tcagtgatacgtctcacgaccggtgctcgatttagagtgagctcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccnccaggctccaggcaagggcttggagtggctggcagttgttcatctggaaggagtgttcaatactatacagactccgngaagggccatttcaccatcnccagagacaattccaagaacacgatgtatctgacaatgacagacctaagagttagaggacacggctagtttatactagtacgaaagaggggatacgagtgcagctaccgaagtactactttagtacttcgtacggggtccgacgggtaacccgtcgggttaccgaccgttctccctacgacgtacccg

SEQ ID NO: 102123 - DNA, 581 bp, Homo sapiens
  misc_feature: GYAE6OF02GWI06.9.33.C11.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
  modified_base (521)..(521): a, c, t, g, unknown or other
  misc_feature (521)..(521): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgagggggaaanagccaccctctcctgcagggccagtcagagtgttaccacctagttagcctaggtaccaacacaaacctggccaggcctccacggcccctnactcttgatgctatccatcgacggccacgtggcactcccaagccgtaggttcaggtggactaggtcggggtactggggacacggtacttcaacttctaccaccacgtcacgccagacctaagacgacctagaacgttagtttgacttagtttacttactgttacaactactacgtacgtagtcggccgtcggggacctcgttccgccgtaggaacctaaagtcganacgtacgaacgtacgtggtggactcgactaccattctcgttctactacttccctcgtacc

SEQ ID NO: 102124 - DNA, 576 bp, Homo sapiens
  misc_feature: GYAE6OF02F369K.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccacctctcctgcagggccagtcagagtcgttaccaccagttagcctaggtaccaacacaaacctggccaggcctccacggccctcattcttgatgcatccatcgagggccagtggcactcccagccaggttcaggtcggcaggtcgggtctgggacaggtacttcactctacaccatcagcacgcctagacgcctagtaagttatttcgacttagtttactactgtacaactagtaccgtacgaggtcggccgtccggggaccttacgttccggccgtacggtaacctaaacgtcgaacgtactacgaacgtacgtcggtcggactacgaccacgtacgtcttcgttaccttactacttccgtccgtac

SEQ ID NO: 102125 - DNA, 701 bp, Homo sapiens
  misc_feature: GYAE6OF02JR2AM.9.33.C11.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (683)..(683): a, c, t, g, unknown or other
  misc_feature (683)..(683): n is a, c, g, or t
tcagtgatacgtctcacgaccggtgctcgatttagagtgagctcgttgggtttggggaggaactgctcagttaggaccacgagggaaccatggaagccccagctcagcttctcttcctcctgctactctggctccagataccacggagagattgtgttgacacagtctccgagccacctgtctttgtctcgagggaanacgccaccctncctgcagggccagtcagagtgttaaccaccgtagttacgccgtaggtaaccaacacgtaaaccgtcggacctacgggccttaccccgaacgggtacccccttactattccgttttagacttcggactaagtccctagtccgacgggcccacgtcggctaactcccgagtacctggttacaaggtcggccgtaaggtcggggtaccaggggaaccaggtacccttacgaccgttactaccgtaacacgtcgaacgccacggaccttagaccgtccgtaaggacgttactttaggactttaaggtttaactacgttaggttacctaaacgtacttaccgggtaacgcgtttccgggaacccggttcccggggcccttaacggtttccgggaccccgttagggtaaaccctaaggttcgaacgtataaccgtaaacgtcgtacggttacggcttacggcctactacgtcttacggtnttccacgttcctcccgac

SEQ ID NO: 102126 - DNA, 558 bp, Homo sapiens
  misc_feature: GYAE6OF02HC1DQ.9.33.C11.1.454.CMB.1.raw
  modified_base (361)..(361): a, c, t, g, unknown or other
  misc_feature (361)..(361): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctcatctttgatgcatccatcacgggccactggcactcccagccaggttcagtggcaggtgggtcgtggacngacttcactctcaccatcagcagcctagacgcctagtaatagtttgacgttaagtttacttacttgtacaatactcgtaccgtagtcggccgtccggggcctacgttccggccgtacgggaacctaaagttcgaagtactacaacgtaactggtcggcgtcgaccacctattcgtcgtccttcgacttcctcccgtc

SEQ ID NO: 102127 - DNA, 583 bp, Homo sapiens
  misc_feature: GYAE6OF02HS2YC.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttacgcctggtaccaacacaaacctggccaggctcccaggcccctcatctttgatgcatccatcagggccactggcatcccagccaggttcagtggcaggtgggtctgggacagtacttcactctacaccatcagcagcctagacgcctagaagtatttgacttagtttattacttcgttactaacacttaccgtaccgaggtcggcccgtccgggggtcctaccgtttccggtcccgtacgggtaaccgtaaagttcgaagtacgtacaaccgtaacgtacggtcggactaggacctaccgagttcttcgttccttactacttccgtcccgtaccg

SEQ ID NO: 102128 - DNA, 600 bp, Homo sapiens
  misc_feature: GYAE6OF02HY3SM.9.33.C11.1.454.CMB.1.raw
  modified_base (180)..(180): a, c, t, g, unknown or other
  misc_feature (180)..(180): n is a, c, g, or t
  modified_base (365)..(365): a, c, t, g, unknown or other
  misc_feature (365)..(365): n is a, c, g, or t
  modified_base (529)..(529): a, c, t, g, unknown or other
  misc_feature (529)..(529): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctaccgcttaaaccgggacaaccgtcgcccggccaacatagccttctccgtcccccttgcagtaacaccaagtacaggaatattaacctgttcccatcgactacgcctttcggctcgccttagggtcactcacctgccccgattacgtgacaggacctgtctcgcgagcggcttttcaccgtntttatcgttacttatcgtcagctactttcgctacttctgtactacctccaagccatcgcctcacacgcactaccttcacgtagtaccttaacacgtaaccgcctacccctaaccaaacaaccgcaacgtaacgccgtacgccgtacgccgacgtacgcgttcgngtctacgttcggttaacgtccccgtttcaccgtttcctccccgtctactccgtaggtaactccgttatccg

SEQ ID NO: 102129 - DNA, 586 bp, Homo sapiens
  misc_feature: GYAE6OF02G7HIN.9.33.C11.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangcccaccctctcctgcagggccagtcagagtgttaccacccagttagcctggtaccaacaccaaacctggaccaggcctcccaggccccctnatcttgatgcatccatcaggccactggcatcccagcccaggttcaggtggctaggtgggtctgggacagacttcactctcaccatcagcagcctagngcctgaagtntttgctagtttacttactgttacgtaactacgttcgtaccgtaggtcggccgttcccgggggcctacgttttccgggcccgttacggggaacctaaacgttgaacgtacgtaccaacgtacgtaggtcggactcggcctacctacgtccgttcgttaccttccgtacgttcccttcccgtaccg

SEQ ID NO: 102130 - DNA, 560 bp, Homo sapiens
  misc_feature: GYAE6OF02H22SS.9.33.C11.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
  modified_base (451)..(451): a, c, t, g, unknown or other
  misc_feature (451)..(451): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctccaggggaaanagccaccctntcctgcagggccagtcagagtcgttaccacccagttacgcctggtacccaacaccaaactcggccaggctcccgaggccccctnattcctttgatcgctacttccattcgagggcccacgtggccactccccgagcccgtaggttcaggtgcgaggtgggtctgggactaggtacttcgactctacgaccatcngcagctagacgcctagaacgtattttcgcttagtttattacgttntactaactctcgtacgagtcgccgtccgggctaccgtttcgccgtaggacctaatgatacacaacgtagtgtgctcgactacattcgtctccttcacttccttccgtac

SEQ ID NO: 102131 - DNA, 866 bp, Homo sapiens
  misc_feature: GYAE6OF02GON1G.9.33.C11.1.454.CMB.1.raw
  modified_base (202)..(202): a, c, t, g, unknown or other
  misc_feature (202)..(202): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgctccgaggggaaanagcccacctctcctgcagggccagtcaggtagtcgttaacccacccagtttacgcccgttaggtaacccaaacaacctaaacccgtgggacccaaggggtccctaccccgaaccgggccccccttacaacttccgttttaggacttgcctaacgtcccaatccgaacggggcccacgtcggaccactccccgaagcccgtaagggttccagggtcggcgtaggttcggggtaccgtggggaacctaggtaccttccgaacttccgtaccctaaccgtacttacccgaacgggtcctaacggtacccgttaacggaaccgtacccgtaaggtaaacgttacgttttttacggaccgtttaaggttttaactttaccgttacggttaaccttaaacgttaccgttaccgggttaacccggtagggtttacccggggtccccgggttccccggggggtaacccgtttaacccgggttttccccggggtacccggttacccgggggttaaaacccttaaaacggtttcgggtaaacgtaaccgtaacccggtaaaaccggtaaccggtttaacggttacgggtacccgttaccggacccgttaacccgtacgtttacccgttacggttaccttttaccgtacctttaccccgttacccccggtacccg

SEQ ID NO: 102132 - DNA, 604 bp, Homo sapiens
  misc_feature: GYAE6OF02JC13R.9.33.C11.1.454.CMB.1.raw
  modified_base (532)..(532): a, c, t, g, unknown or other
  misc_feature (532)..(532): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttgcagtaacaccaagtacagaatataacctgttccatcgactacgcctttcggcctcgccttaggggtcactcaccctgccccgtattaacgttggacaggaacccttggtcttccggcgagcggcttttcaccgtctttatcgttactatgtcagctattcgctacttctgacttacctcagcatcgcctcacacgcaactaccgttacacacggtccttacacgaaccgtcctaccccctaaccaaacaccgcaactaacgcgtccgctcgccgacacggtccttcggtnccgtacgttacggtttaccgtcccctttgaccttccgttcccgacctacttcgtacggaactacgtactacc

SEQ ID NO: 102133 - DNA, 583 bp, Homo sapiens
  misc_feature: GYAE6OF02HSYQK.9.33.C11.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
  modified_base (448)..(448): a, c, t, g, unknown or other
  misc_feature (448)..(448): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctccgaggggaaangcccaccctctcctgcagggccagtcagagtcgttaccacccagttagcctaggtaccaacacaaacctggccaggcctcccacggcccctcattctttgatgcatccatcgagggccacgtcggcactcccagccgtaggttcaggtgcgtagtgggtcgtgggacagactcactctacaccatcancacgctagacgcctagaagtagtttgactagtttatactgtacaacattccgtacgngtcggccgtccggggacctaccgttccggcccgtacgggtaacctaaagtgaacgtagtaccgaaacgacgtacggtacggctacgacctaccgtacttcgttcgttccttacgtaccttcccttacccgtaccg

SEQ ID NO: 102134 - DNA, 558 bp, Homo sapiens
  misc_feature: GYAE6OF02F3E49.9.33.C11.1.454.CMB.1.raw
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccaggggaaanagccaccctctcctgcagggccagtcagagtcgtaccaccagttagcctggtaccaacacaaacctggccaggcctcccgaggcccctcatctttgatgcatccatcgaggccactggcactcccagccaggttcagttggctaggtgggtcgtgggacacggtacttcgactctcacctatcagcacgcagacgactagaagtatttgacttagtttattactgtacactactcgtacgngtacgccgtccgggacctacgttccgccgtacggacctaaagttgaacgtactacgaacgtactaggtcggctgaccacgtacttcgtacttccgttcacttccgtaccccgtac

SEQ ID NO: 102135 - DNA, 573 bp, Homo sapiens
  misc_feature: GYAE6OF02IL7UH.9.33.C11.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggcagtcagngtgttaaccacccagttacgcctggtaccaacacaaacctggaccaggcctcccaggccccctnatctttgatgcatccatcgaggccacgtgcactcccagcctaggtcagtcgcaggtgggtctggggacagtacttcactcacaccatcagcanccagacnctagaagtatttgactagtttatactgtacaanatacgtacgaggcggccgtccggggacctacgttccggacccgtacgggtaacctaaagttgaacgtaactaccgaaacgtaacgtggtacggtacctacggcctacctagtcgtcgttccttactacttcccgtcccgtacccg

SEQ ID NO: 102136 - DNA, 770 bp, Homo sapiens
  misc_feature: GYAE6OF02I6P7R.9.33.C11.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (312)..(312): a, c, t, g, unknown or other
  misc_feature (312)..(312): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagactaccaccggagagattgtgttgacacngtcnccagcccacctgtctttgcctaccgagggaancgcccacctcncctgcgaggccagtcaggagttcgtacccaccgtagttacgccgtaggtaaccaacaccaaaccgtcggccgacggcctacccgacggccccctanacgttctttaggactcgactactccacgtccgacggtccactcggaccaaccgtccccgacgccggtacggttcgaacggtcggctagggtcgggtacggtagggaacctagtacccgttcaccgtacctaccaaccgttacgcgacgacgtaccgtaaccgtacggacgtaccgttaggaacgtttacgtttgacgtttaacgttttaatacgtacggttaactaacgttacggttaccgttaaccgggaggttcccggggtcccggttaccccggggtacccttttaccggttaccccgggtaccggttaaaaccgggtacctttaaaaggttaccggaacggtaaacgttaacccggtaaacgtccggttacggtccggaccgttaccgaaccttaacccggtgttaccgtttccggttaccttaccgtaccgttaccccggttccccgtaaccg

SEQ ID NO: 102137 - DNA, 590 bp, Homo sapiens
  misc_feature: GYAE6OF02IM2SP.9.33.C11.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (358)..(358): a, c, t, g, unknown or other
  misc_feature (358)..(358): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggcctcccagataccaccggagagattgtgttgacacagtctccagccaccctgtctttgtctccgaggggaaancgccaccctctcctgcagggccagtcagngtgttaccaccagttagcctggtaaccaacacaaacctggccaggcctcccgaggcccctcattctttgatcgcactccatccgaggcccagtcggacacctcccagccgtaggtcaggtggntaggtgggtctgggacagtacttcacttcacacctatcagcacgcctagacgctagtaagtatttagacttagtttattactgttacaacgtactacgtacgagtccggtccgtccgggtacctccgttccggccgtacgggtaacctaaagtgaacgtactaacgaacgtaacgtcggtcggtctacgacctaccgtacttcgtctaccgttactacttcccgttcctacc

SEQ ID NO: 102138 - DNA, 619 bp, Homo sapiens
  misc_feature: GYAE6OF02G85NV.9.33.C11.1.454.CMB.1.raw
  modified_base (295)..(295): a, c, t, g, unknown or other
  misc_feature (295)..(295): n is a, c, g, or t
  modified_base (432)..(432): a, c, t, g, unknown or other
  misc_feature (432)..(432): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaagagccaccctctcctgcagggccagtcagatgttaccacccagttacgcctggtaccaacacaaacctggccaggcctcccgacggccccctnactcttgatgcatccatcgagggccacgtggcactcccgagccgtaggttcaggttcggcgtaggttcgggtacgtggggaactagtaccgttcgactctaccgaccatcagaccacgacctagacgcctaggaatntttgcttagtttacttacttgtacactacgtcgtaccgagtccggccggtccgggtacctaccgtttccgggcccttacgggaaccttaaaggttcggaaacgtactaccgtaaacgtacgttggtacggtactacgaccgtactagtttccgtacggttccttactaccgttacccgttccccacg

SEQ ID NO: 102139 - DNA, 646 bp, Homo sapiens
  misc_feature: GYAE6OF02HOD4M.9.33.C11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (539)..(539): a, c, t, g, unknown or other
  misc_feature (539)..(539): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattgtgttgacacagtctccagccaccctgtcctttgctccaggggaaangtcccacctntcctgcagggccagtcagtagtcgttaccacctagttacgcctaggtaaccaaacaactaaacctggccaaggcctcccaggcccctgaatctttagancgtacactccatcgaggcctactggcactccagcctaggttcagtgcagtggctggacngtactcactcacacatcagcacactagactcctagtaacgtagttttcgacgtagttttaactacgttagttaaccgtaactagttaccggtacgtacgggtacgacccggttacccgggggtaccctaccgtttccgggacccgtacgggtaaacctaaacggttnaacgggttactaaccgtaaacgtaacgtacggtacggtaccgttagaacccgtaaccgttacgtaccgttacgtaaccgttacgtaaccttccgtaccccgtaaccg

SEQ ID NO: 102140 - DNA, 566 bp, Homo sapiens
  misc_feature: GYAE6OF02HDTJ5.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangcccaccctctcctgcagggccagtcagagtgttaccacccagttacgcctggtaccaacacaaacctggccaggctccaggcccctcatcttgatgcatccatcgagggccacgtggccatcccagccaggttcaggtggcaggtgggtctggggacagtacttcacttctacacctatcagcacgcctagacgccgtagtaagttatttcgacgttagtttattactgtactaactactaccgtacgagtcgggtcccgtccgggggtaccctccgtttccggcccgttacgggaacctaaagtcgaagtactacgaacgacgtggtgctgacaccatctcgtcttcacttcctcctacc

SEQ ID NO: 102141 - DNA, 557 bp, Homo sapiens
  misc_feature: GYAE6OF02IX6T5.9.33.C11.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaangccaccctctcctgcagggccagtcagagtgttacccaccagttagcctggtaaccaacacaaacctggccaggctcccacggcccctcactcttgactgcactccatcgacgggccacgtggcactcccagccaggttcagtcggcagtgggtctgggacagacttcactcncacntcacgcacgcctagacgctagatatttgactagtttatactgtactaactatccgtacgtaggtcggtacccggtcccggggtacctacggtttccgggcccgtagggaaccctaaagttcgaagtactacgaagtactggtggctagccactatctgttcctacacttcctccgtac

SEQ ID NO: 102142 - DNA, 552 bp, Homo sapiens
  misc_feature: GYAE6OF02I116Y.9.33.C11.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccacctctcctgcagggccagtcagagtgttacccacccagttacgcctggtaccaacacaaacctggccaggctcccaggcccctcatctttgatgcatccatcagggccactggcatcccagccaggttcagtggcaggttgggtctggggacaggacttcatctcacntcagccagcctagacgcctagacgtatttgactagtttatactgttacaactatcgtaccgagtcggcccgtcggggcctaccgttcggcccgttcgggaacctaaaagttcgaagactacgaacgtaacgtcggtggctcgaccactacgtctcgttctctacttcctccgtacc

SEQ ID NO: 102143 - DNA, 687 bp, Homo sapiens
  misc_feature: GYAE6OF02HHAYN.9.33.C11.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccacggagagattgtgttgacacagtctccagccaccctgtctttgtctccgaaggggaaancgcccaccctctcctgcagggccagtcagagtcgtaccacctagttacncctaggtaaccaacacaaacctggccaggcctcccaggcccctnatcttgatgcatccatcgacgggccagtcggacactccccgagcccgtaggttcaaggttcggacaggtcggggtactaggggacagtaccttcgaaccttctaccgaacagtaccaggacctacgacctaagcgtacctaggtaaagtattttggacttaaggttttacttaactacgttaactaaacgtacttaccgtaccgaggtccgggtcccggttacccgggggtacccttacgtttcccgggacccggttacgggaaacctaaaagttacggaacgtaacgttaaccgaaacggtaacgttcggtaacggaccttagggaaccctaacctaagtttaccgacggttttaccttaccgtaacgtttcccctaccccggtaaccc

SEQ ID NO: 102144 - DNA, 720 bp, Homo sapiens
  misc_feature: GYAE6OF02HMAJY.9.33.C11.1.454.CMB.1.raw
  modified_base (209)..(209): a, c, t, g, unknown or other
  misc_feature (209)..(209): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagactaccaccggagagattgtgttgacacagtctccagcccacccgtgtctttgtctaccgaggggaaancgccaccctctcctgcgagggccagtcgagagtacgttaaccacccgtagttacgccgttaggtaacccaaacaccaaaccgtcggaccaaggcctaccccgaggtccccctacattccgtttgatcgcactccatcgacggcctactcggaccacgtcccgacgtccgtaggttccaaggtcgcgtaggttcgggtactggggactacggtacttaccaccgttccgtacctaacctacgtacacgtaccgaccgtacccgtaaggtaaccgtccgttaaggtaaacgtttagttttacggaactttaaggttttaacttacgttacgttaaccgtaactacgttaccgtaacggtacggtccgggtacccgggttccgggtaccttaccggtttcccggaccgtaacggaacgtaaacgtggaacgtactaaccgaacgtacgttcggtcgtacgacgtacctaccgtagttcgtcgttacccgttactaccgtttcccgtacccgtac

SEQ ID NO: 102145 - DNA, 583 bp, Homo sapiens
  misc_feature: GYAE6OF02JVD9I.9.33.C11.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (286)..(286): a, c, t, g, unknown or other
  misc_feature (286)..(286): n is a, c, g, or t
  modified_base (374)..(374): a, c, t, g, unknown or other
  misc_feature (374)..(374): n is a, c, g, or t
  modified_base (442)..(442): a, c, t, g, unknown or other
  misc_feature (442)..(442): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccacgganagattgtgttgacacagtctccagccacctgtctttgctccgaggggaaangccacctntcctgcagggccagtcagangttaccacccagttagcctggtaccaacacaaacctggccaggcctccacggccccntatcttgatcgcatccatcgacggccactggcactcccagccaggttcagtcggacgaggtcgggtactgggacagtaccttcactcncaccagtcacgcagccgtagacgctagaatagtttgacgtagttatactagtctaactgtacgtacgngtcggtcgtccgggctaccgtttccggaccgtacgggtaactaaacgtacgagtaactacgtaacgtacgtaggtacggacgtacgtaccaaccgtagttccgttacggttccttactaccgttaccgttaccccgtaccg

SEQ ID NO: 102146 - DNA, 572 bp, Homo sapiens
  misc_feature: GYAE6OF02I8PGU.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtcgttaccacccagttacgcctggtaccaacacaaacctggccaggctcccacggcccctcatctttgatgcatccatcgagggccactggcactcccagccaggttcaggtggctaggtgggtctggggactaggtaccttcgacctctccaccatcacgcacgcctagacgcctagaagttatttgacttagtttattactgttactaactagtacgtaccgtaggtcggtcccgtccggggcctccgtttccggacccgtacggaacctaaagtcgaagtactacgaacgtacgtgtcggtctacgccacatctcgtccttcacttcctccgtacc

SEQ ID NO: 102147 - DNA, 704 bp, Homo sapiens
  misc_feature: GYAE6OF02GXMGL.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgttctttgtcctccgaggggaagcgcccaccctctcctgcgagggccagtcagagtcgttacccaccctagttacgcctaggtaacccaacaacctaaacctggaccaggcctacccgacggccccctacacttctttagactcgcctactccagtcgacgggcccacgtcggcactcccgagtcctacggttcgagtggccgtaggtcgggtcgtagggactagtaccttcgacttccaccacctatcgacgcgacgtaccgtacgacgtccgtaaggtaacgttagttttacgactttaacgttttacttacgttagttaacctaacttacgttaccgtaaccgtacggtccgggtacccgggttacccgggggtacccttaccggtttacccgggacccgttaaccgggaaccgttaaacgttcggaaacgtactaaccgtaaccgtacgtaggtacggtaccgtacgtacctacgtacttcgttacttaccttactaccgttcccgtacccgtaccg

SEQ ID NO: 102148 - DNA, 828 bp, Homo sapiens
  misc_feature: GYAE6OF02IPMNH.9.33.C11.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctcgaggggaaancgccaccctctcctgcagggccagtcagngtcgttaccaccagttacgcctggtaccaacacaaacctggccacggctcccgacggcccctntacttcttgacttcgctatccagtccgacgggccacgtcggaccactcccgaaggtccgtacggttcgaggttcggacgtacggttcggggtactacggggactacggtacctttacgaccttacctacctaacccaagttccgaacgaccgtaacgtacccgtaagacccggtaccgttaaggtaaacggtttagttttaaccggtacgtttaacggttttttaaccgttaccgtttaacggttaaccgttaaaccgttaaccggtttaccggttaacccggttacgggtacccggggttacccgggttcccccggggggttacccttaacccgggttttcccggggtaccccggtttaaccggggtaaaacccgtttaaaaacggtttcggaaaaccggttaaccgttaaacccggttaaaacggttaccgtttacgggtacgggtaacccgttacgtaacccgtaaccttacggtttccgtttaccggttaccctttaccgtaaccttttccccggttaccccgtaaccg

SEQ ID NO: 102149 - DNA, 602 bp, Homo sapiens
  misc_feature: GYAE6OF02I35Z8.9.33.C11.1.454.CMB.1.raw
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (376)..(376): a, c, t, g, unknown or other
  misc_feature (376)..(376): n is a, c, g, or t
  modified_base (480)..(480): a, c, t, g, unknown or other
  misc_feature (480)..(480): n is a, c, g, or t
tcagtgatacgtctcacgaccggtgctcgatttagagtgagctcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctccgtgtgcagtctctggacttcaccttnaagtaactcggctgcacgtgggtccncgaggctaccgaggcaagggcttgggagttggctggctagttgttcatctaggaagagttgtacaatctaatacgagacctcgtagaaggtccgaattcaccgatctacagganacaaacttccaaagacacgtagtgtactctcgacaaagtgacagacgtaagagttgaagacgacggtcttagtttataacgtgaaacggtaaaggaggggtaanaacggtaagtcggaagtacgaacgtaccaaggttacttaacgtttcgtaaccgtttacgtaccggggaccgtaacggaacccgttaggtaccctaccgtcctacccgttacacccgtacccg

SEQ ID NO: 102150 - DNA, 731 bp, Homo sapiens
  misc_feature: GYAE6OF02ITDV9.9.33.C11.1.454.CMB.1.raw
  modified_base (255)..(255): a, c, t, g, unknown or other
  misc_feature (255)..(255): n is a, c, g, or t
  modified_base (701)..(701): a, c, t, g, unknown or other
  misc_feature (701)..(701): n is a, c, g, or t
tcagtgatacgtctcacgaccggtgctcgatttagagtgagctcgtgggaggaggagcccagcactagaagtcggcggtgtttccattcagtgatcagcactgaacacagaggactcacatggagttggactgactggtattttccgtttggtatttaaagtgtccagtgtgagtgcagcgtggtggagtcgtggggagtcgttggtgcgagccgtggactcctcctggacgactctccgtgtcgccgtcctcgnggtacttacgattggtttagaattggtacttacgtcgacctagttcgccgtaccggtggggttacccgactaaacggttccggaaggggtaacggtccgtagggtacggttcgggtcttaacgaacgggttaactttacggtagggtaacggtacgacgtaacctaaccggaacgtacggttacgtaagtccggaccgttacgttcgttacgggtacgggaaccggggtctaacgtttacccgaaccttataccgttaccgaggaaacgaaccgtaaacggtaacccgtaaacggttaaacccttccttaaattacgttaccggtactaaacgtaaagtagttaaccggttgtaccgttaggtacgtaggtttaggaaccgtacggacggttacgttagttacgtacgttaggaccaaggtaaaacgtcggaaaccgggtaaccgngggacgacacgtaagtcggtccttatacgg

SEQ ID NO: 102151 - DNA, 701 bp, Homo sapiens
  misc_feature: GYAE6OF02JRAYI.9.33.C11.1.454.CMB.1.raw
  modified_base (198)..(198): a, c, t, g, unknown or other
  misc_feature (198)..(198): n is a, c, g, or t
  modified_base (642)..(642): a, c, t, g, unknown or other
  misc_feature (642)..(642): n is a, c, g, or t
tcagtgatacgtctcacgaccggtgctcgatttagagtgagctcgttgggtttcctcgttgctctttaagagtgtcagtgtcaagtgcaactggtggagtcgtgggggggcgtgggtccagcctgggaggtccctgagactctctgtgcaggctcgtggattcaactttcaagtaactacggcgtgcacgtgggtccnccaggctccgaggacgaagggcttaggagttggcgtgcaggttcttcatcctgtaaggaatggttacaatactatacagactccggtagaagggccgaattcgaccgtactctccagacgaacattaccaagtaacacgatacgtatacctgactaaaagtcggaacactacgtaaagtacggttacgtaagaccgtacggtactttagtttaacgttaactacgtaaacggaaacgggtaagggggtaactaacgtacggtaagggacctacggaccttaaccggtaacgttaacgttaccgttagttaaccttcggacggggaccgttaacggaacccgttggtaccgaccgttccgtacctgaaaccgtcctaacccgacctaacgggcccaacgttcggtacccgttcccgtcgcccgtccgtacgccctgggtaacccncgggacctaacccggcgttaaccgcggtacccaacggacggttacccgccggttaccgg

SEQ ID NO: 102152 - DNA, 899 bp, Homo sapiens
  misc_feature: GYAE6OF02JNY4D.9.33.C11.1.454.CMB.1.raw
tcagtgatacgtctcacgaccggtgctcgatttagagtgagctcgttgggtttgggggtagggaacgtgctcagttaggacccagagggaaccatggaagccccagcctcagcttctcttcctcctgctactcctggctcccagatacccaccggagagattgtgttgacacagtctccagcccacccttgtcctttgtctccgaggggaagagccaccctctcctgcagggccagtccagagttcgttaacccaccctagttacgcctggtacccaacacaaaccgtggacccaggcctccccgacgggtccccccctacgtaacttccgttttacggacttcggtacctaacttaccccaactttcccggaaaccgggggccccaaaccgtttcggggaaccccctagttacccccccgaaggtcccccgaaacggggttttcccaaagggtttccgggggcctaacggggtttgggggtccccggtttaacgggggggaacctaaacgggtttacccgtttacccctaacgtttaccccgttaacccctaaccccggtaacctttacgaaccgggtaccctaaaccgggtacccctaaacgggtaccggtaccctaacgggtaaaggttaccgtttttacggaccgtttaaggtttttaaaccttaaccgtttcgtaacgttaaaccctacgttaccggttaacccgttacgggtaccgggtcccggtcccgggggtcccttacccggttttcccggtacccggtaaccggggttaaccctaaaggttcgtaaggtaccttaaccgaaccggtaccttacgggtacggttacgtacggtcctaacccgtacgttcccttagttcccttacctttccgacccgtttaccccgtcccg

SEQ ID NO: 102153 - DNA, 579 bp, Homo sapiens
  misc_feature: GYAE6OF02F9PLQ.9.33.C11.1.454.CMB.1.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaaggggaaangccaccctctcctgcagggccagtcagagtcgttaccaccagttagcctggtaccaacacaaacctggccaggctccacgccctcatcttgatgcatccatcgacggccacgtggccactcccagcctaggttcagtcgcaggtggtctgggacagacttcactctcacctatcagcacgcctagcgcctagtaacgtattttgacttagtttatactgtacactntcgtacgngtcggccgtccgggcctacgttccgccgttacggaacctaaagttcgaacgactaccgaacgtaacgtcggtacggtccgtacgacccgtaaccgtacttccgttacgttcctttacctacgttcccgttacccgtacccg

SEQ ID NO: 102154 - DNA, 808 bp, Homo sapiens
  misc_feature: GYAE6OF02HR9LF.9.33.C11.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtctttgtctccgaggggaaanagccaccctctcctgcagggccagtcagagtgttaccacccagttacgcctggtaccaacacaaacctggccaggcctcccacggcccctnattctttgatgcatccatccgagggccactcggcactcccagcctaggttccaggtcggacgaggttcgggtactggggaacacggtaccttcgaaccttccgttaccaaacccgtacgttcccgaaggtacccgtaacggtacccgtaacggaaccggtacccgttaaggtaaacggtttagtttttacggaccgttaaggtttttaacgtttaaccgttacggttacctaaaacccgttaacgtttaccgggttaaaccggtacgggttaccggggttacccgggttaccccggggggggtaccccttaacccgggttttacccggggtaccccggttaaccggggttaaacccgtaaaaacgggtttcggaaacggtaacgttaacccggtaaaaccggttaaaccggttacgggttaacgggaccgttacgggacccgtaacccgttaacgttccgtttaacggtttaccttttacccgtaaccgtttccccgtttaccccggtaacccg

SEQ ID NO: 102155 - DNA, 699 bp, Homo sapiens
  misc_feature: GYAE6OF02HNT0N.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgagggaaagngccacctctcctgcgagggccagtcagagtgttaccaccagttacgcctaggtaccaacacaaaccgtcggaccacggctcccgacggcccctcactctttgactcgactacgtaccatccgacgggcctaaccgtggaccactcccaggccgtaaggttccaagggtcggacgtaggtcggggtacgttacggggactaacgtaccgttacgtaccttctaccaacccgtagttaccgaacgaccgtacggtaccgtaacggaccggtacccgtaaggtaaacgttacgtttttacgacgttaagttttacgttaacttcggtaactaacgtacttacgtaaccgtaggtccggtaccggttccggggaccttaaccgtttccggaccgtacgggtaacctaaaacgttgaacgtactaacgaacgtacgttacggtacgtacgtacgacctaaccgcgttactcggttccttacgtaccttccgtccctaacc

SEQ ID NO: 102156 - DNA, 867 bp, Homo sapiens
  misc_feature: GYAE6OF02JHGQN.9.33.C11.1.454.CMB.1.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtctccagccacctgtctttgctcgagggaanagccacctctcctgcagggccagtcagagtcgttaaccacctagttacgcctaggtaaccaacacaaacctcggccaggccncccgacggtcccctcacttctttgactcgcactccatcgacggcacgtggacactacccagaccgagttacgaggtcggctaggtcgggtactacggggactacggcttacgaccttacgtaccaacctagtacctaacggccgtaacgtacccgtaagggtaccgtacccgtaaggtaaacggtttacgttttacggtaacgttttaaccggttttttaataccgtttaccgttaaccgttaaaacctaccgggttttaacccggtaacccgggttaacgtttacccggggggtcccccggggtttaaccccggggggtacccgttttaaccccggttttaccccgggggtaccccccggtttaaaccgggggggttaaaaacccttaaaacgggtttttaccggggaaaccgtttaaacccgttaaaccggggtaaaaacccgttaaccggggttacggggtttaaccggggttaccccgtttaaaccgggaacccctttaacccggtaactttacccggtttacgttttaccccgttttaccggtaaccccggttttccccctttaaaccccccgggttccc

SEQ ID NO: 102157 - DNA, 638 bp, Homo sapiens
  misc_feature: GYAE6OF02GZD1G.9.33.C11.1.454.CMB.1.raw
  modified_base (205)..(205): a, c, t, g, unknown or other
  misc_feature (205)..(205): n is a, c, g, or t
  modified_base (412)..(412): a, c, t, g, unknown or other
  misc_feature (412)..(412): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcagggccagtcagagtctaccaccagttcgcctaggtaaccaacacaaaccgtgccaggcctcccacggcccctcgattcctttagatcgactactaccataccgacgggcccacgtcggcctactcccagacctacggttcgaggtcgcgtaggtcgggtcgtagggacagtacttacgactctaccacancagcacgactacgctaccgtagaagttagtttacgacgttagtttaacttacgttacgtactaacgttacgtacgttaaccggtaggtccgggtcccggtccgggtaccttacggtttcccggtaccgtacgggtaaactaaacgttcggaacgtaactaacgaacgtaacgtcggtacggtcagtacctacgtagttctcgttactaccgtcgttcctacccgtc

SEQ ID NO: 102158 - DNA, 805 bp, Homo sapiens
  misc_feature: GYAE6OF02GOCQ3.9.33.C11.1.454.CMB.1.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctcagccaccctgtctttgctccgaaggggaaancgcccaccctctcctagcagggccagtcagagtcgttacccaccgtagttacgcctaggaaccaacacaaacctcggaccgacggcctcccgaccggcccctcacttctttgattcgacactcccacgttacggaacggggtcccctacgtacgggaccacgtccccgaacggtcccgtacgggttaccgtacgggtacgggtacgtagggttcggggttcgtaacgggggaaccgtaacggtaacctttccgtaaccttcctacccgaaccctacgttccgaacgtaccgaccggtacccgttaaaggacgtacccggttaaggtaagtttaacgttttcgtaacgtttaggttttaacttacgttaccggttaactaaccggttaaccttccgggtaacccgaggttacccgggtcccgggttacccggggtaccctttacccgggtttcccggacccggttaccgggtaaaccctaaagttccggaaagtaacccgtaaccgtaaaacggtaccgttagggtacggtcctacggacccgtaaccgttacgttccggtttaccgtacccgtttactaccggtttccccttaccccgtacc

SEQ ID NO: 102159 - DNA, 817 bp, Homo sapiens
  misc_feature: GYAE6OF02H2I70.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccggagagattgtgttgacacagtctccagcccacccgtgttctttgtctccgaaggggtaagcgacccaccctctcctcgccgacgggccagtccaggtagttcgttaccgaacccgtaggttacgcccgtacggtaaacccaaacaaccgtaaaccgtccggtaccgacggtccctaccccgaaccgggtcccccctacgtactttccgttttagacgtacgtaccaccgttccgtacgttacggaaccgggtcctaaccggtccggactacccgtacccgtacggacccgttacggttacgacgggtcggtacggtagggttcgggtccggtagggaccgacgtttaacctcgtacctacctacccgtaacgtacgtcgacgtaccacggtacgtaacgccgttacgttagtaactttagtttacgacgttaacgttttattaccgttacacgttaaacgtacgttaccgggtaaccgtaggtcccgggtacccgggtaccccggggttacgttaaccccggtttccggaacccgggtacccggggtaaacttaaaccgggttagaacgttaaccgaaccgttaaaccgtcgggttcggtaacggtctacgtcccgtaaccgttcgttcgtaccgttccgttaccgtaccttcccgttaccccctacg

SEQ ID NO: 102160 - DNA, 663 bp, Homo sapiens
  misc_feature: GYAE6OF02FTZE9.9.33.C11.1.454.CMB.1.raw
tcagtgatacgtctcacgaccggtgctcgatttagagtgagctcgttgggtttgggggtaggtaacgtgctcagttaggacccagagggaaccatggaagccccagctcagcgttcctcttcctcctgcctacgtctggctcccagataccgaccggacgagattgtgttgacacagtcctcccagccaccctgtctttgtctccagggtaacagccacctctcctgcagggccagtcagagtgttaccaccctagttacgcctggtaccaacgactaaacctggtcctaggtcttaccctaaggtcccccgttcactcttttcgaacttggacctactccatccaagggtcctactggcactcccagtccaggttcagtaggcgtagtaggtctagggacagtacttcactctcacctagtcaagcacgcctagacgcctagagtatttgactaagtttacttacgttattactaacgtacttccgtaccgtagttacgggtcccttaccggggtcctaccgtttccggacccgttacgggtaacccgtaaacgttcgtaacgtacgtaccgaaccggtaacgtacggtacggaccgttacggtacctaacccgtagttaccgtacgttaccgtttaccgtacttcccgttacccgtacccg

SEQ ID NO: 102161 - DNA, 588 bp, Homo sapiens
  misc_feature: GYAE6OF02HBS6F.9.33.C11.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctcaggggaaangccacctctcctgcagggccagtcagagtcgttaaccacccagttagcctgggtaaccaaacacaaacctggaccaggcctcccaggccccctnattctttnatgctatccaatcgacggccaactggacactccccagcctaagggtttccaaggtcggacaaggttggggtctacgggggacaggtaccttcgaccttacncaccatcacgcagacctagacgactagaagtatttgactagtttaattactgttacaactacacgttacgacgtcggtcgtccggggtacctacgttccggcccgtaggaacctaaaagttgaacgataacaacgtactaggtgctcgacacgtatacgttcgtacttcacttccgtaccgtac

SEQ ID NO: 102162 - DNA, 691 bp, Homo sapiens
  misc_feature: GYAE6OF02HRUZL.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaaccacccagttacgcctggtaccaacacaaacctggccaggcctcccaggccccctcatcttgatgacatccatcgagggccactggccatcccagccaggttcagtggcaggtgggtcgtgggacagtacttcactctccaacctatcacgcagacctagacgtccttaggaagtattttagacttaggttttaacttaacgttgttacctaaacgtaacgttaccggtaaccgtaacggtccgggtacccggttaccccgggggggtacccttaccggttttaccccggggtaccccggttacggggtaaaccccttaaaaagtttcggaaacgtaccgttaaaccgtaaaccgtaaccggttacggtacgggtaccgttacggtaccctaacccgtacgttcgttacggtttacctttaccgtaacctttccccgttaccccgtaacccg

SEQ ID NO: 102163 - DNA, 743 bp, Homo sapiens
  misc_feature: GYAE6OF02IKY21.9.33.C11.1.454.CMB.1.raw
  modified_base (206)..(206): a, c, t, g, unknown or other
  misc_feature (206)..(206): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaanagccaccctctcctgcagggccagtccagagtcgttaccacctaagttagccctaggtaccaacaccaaaacctggaccacggcctacccgacggccccctacacttcttttaggactgctacttcccaacttcgacgggccaacgtggccactcccagccctaggttacaggtcggacgtaggtcgggtacgtgggacaaggtaccttcgactctaccgaacctaagtccaagccaagtacctaaggacgacccgtaagtaaaacgttagttttaacgacgttaagttttaaacgtttaacgttacgttaacctaaaccttacggttaaccggtaaacccggtaggttccgggtacccgggtcccgggggtaacccttaccgtttaccccgggacccgttaacgggtaaacctaaaaacggtttcgaaacgtaactaaccgtaaaccgtaacgttcggtaacggaccgttacgaacccgtaaccctaagttaccttacggttaccttaccgttaactttccccgttacccgtaacc

SEQ ID NO: 102164 - DNA, 791 bp, Homo sapiens
  misc_feature: GYAE6OF02H96WO.9.33.C11.1.454.CMB.1.raw
  modified_base (211)..(211): a, c, t, g, unknown or other
  misc_feature (211)..(211): n is a, c, g, or t
tcagtgatacgtctcacgaccggtgctcgatttagagtgagctcgttgggtttgggggaggaactgctcagttaggacccagagggaaccatggaagcccccagctcagcttctctttcctcctgctactctggctcccagatacccaccggagagattgtgttgacacagtcctccagcccaccctgttctttgtcctccgaaggggaanacgcccaccctctcctgcagggccagtcagtagtcgttaacccacccgtagttacgacctaggtaaccccaaacgaacctaaacccgtcggacccgaacggtcccgtaccccgaaccgggtcccccctatacttaccgtttagacgttccgactacccttaccccgtaattccggaaccgggtccctaacggttcggaccctaaccgtaccccgacggtacccgtaacggtttcagggtacgcggtaaggtcgggttccgttaggggacctaacggtccttacaccgttcctacccaaccgtctacccgagtaccgaacgtaccgtagtaccggtaccgtagtaaacgtttagtttgaccttaagtttattaaccgtagtactaaacgtacgttaccgtaacggtacggtaccgggtcccggttacccggggtaccgttaccgtttcccggtaccggtaaccgggtaaaccttaaaggtcgaacgtaacgtaacgtaaaccggtaacgttcggtacgtacctcgaacccgttacctagttccgttacgttcctttaccgcctttaccccgtacccgtacc

SEQ ID NO: 102165 - DNA, 728 bp, Homo sapiens
  misc_feature: GYAE6OF02I4LSY.9.33.C11.1.454.CMB.1.raw
  modified_base (162)..(162): a, c, t, g, unknown or other
  misc_feature (162)..(162): n is a, c, g, or t
tcagtgatacgtctcacgaccggtgctcgatttagagtgagctcgtgggagaggagcccagcactagaagtcggcggtgtttccattcggtgatcagcactgaacacagaggactcaccatggagtttggctgagctgggttttcctcgttgctctttaagnggtgtccagtgtcaagtgcaatggtggagtcgtgggggggctggtccagccgtgggacggtccctaggacgactcgtcctggtcgacaggctgtggacttccaccttcagtaactaccggcgtgcacgtcgggtaccgccgagcctaccgaggcaagggtccgttggagttcggctgggctacgtttgttctatccgtagaaggtagtcggttacaacttactagtaacgagtaccgtacccggtgtaaacgggtcccgtatttccgaaccttacgtaccgtacccgtagaacggtaacctaagttaaccccgaaagaaaccgtaacgtaacttaggttaaccttctaacgtacgtaaaagtacgtaaccgacgtaacccggttaagtacggttaacgaacggaccggtaacgggtactttacgggtttaaacttaaccggtagtaaacggtaacgggttacgggggtaacgttaaccggtaaggttaccggtaaccgacggtacccggtaccgtaaacggttttccttaacggtttccgtaacggtttaccggtaaccccggggg

SEQ ID NO: 102166 - DNA, 641 bp, Homo sapiens
  misc_feature: GYAE6OF02IQXPY.9.33.C11.1.454.CMB.1.raw
  modified_base (327)..(327): a, c, t, g, unknown or other
  misc_feature (327)..(327): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (559)..(559): a, c, t, g, unknown or other
  misc_feature (559)..(559): n is a, c, g, or t
tcagtgatacgtctcacgaccggtgctcgatttagagtgagctcgttgggtttggggtacggatttgatgttacctgatgcttagaggcttttcctggaagcagggcatttgttgcttcagcaccgtagtgcctcgtcatcacgcctcagccttgattttccggatttgcctggaaaccagcctaccgcttaaaccgggacaaccgtcgcccggccaacatagccttcctcccgtcccccttcgacacgtaacaccaagtacaggaatattaacctgtttcccatcgacctacgcctttcggcctcgccgttagggtcactcacccngccccaagttacgtgacacggaccttgtccttccggcgacgcgggcttttccgccgtactttctcgtttactatcgtacagctagtttcnctacttacngtacgttacctccagctatcgcctcgaactacgcacctccttacgacgtacgcttaacgacgtactcccaccctaacccgaccaaccgtccaattaacgccttacggtcctacgccgaccgagtccgtacgtnctaggttcggtttaacccgcccgtttacgtaccttcccgttacccgcctaacttcccgtaaggtacaccggtttacgtaccg

SEQ ID NO: 102167 - DNA, 693 bp, Homo sapiens
  misc_feature: GYAE6OF02HKJB3.9.33.C11.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagtgatacgtctcacgaccggtgctcgatttagagtgagctcgttggggtttgggggaggaactgctcagttaggaccagagggaacatggaagccccagctcagcttctcttcctcctgctactctggcctcccagactaccaccggagagtattgtgttgacacagtctccagcccacctgttctttgtctcgaaggggaaancgcccaccctctcctgcgacgggccagtcagagtcgttaaccacctagttacgcctaggtaaccaacaaccgaaacgtcggactacggcctccgacgtcccctnattctttgatcgacatccaagtccgacgggcctacgtggcctaacctcccgagtaccgtacggttacaggtcggcgtagggtcgggtcgtacgggactacggtaccttacgaccgttactaacctacctacgtacgacgccgtaacgacgtaccgtaacgtccgttaagtaacgttacgtttgtaacgtttaacgtttaacttacgttacgtaaacctacgtaacgttaccggtaacgtcgggtcccggtacccgggtcccgggttaccttacggtttcccggaccggtaacgtaaacgtaaagttcgaacgtacaacgtaacgtcgtcggtacgctacgacctacgtagttcgtacgtacttaccgtactaccgtccgtac

SEQ ID NO: 102168 - DNA, 819 bp, Homo sapiens
  misc_feature: GYAE6OF02FRWCT.9.33.C11.1.454.CMB.1.raw
tcagtgatacgtctcacgaccggtgctcgatttagagtgagctcgttgggttttcctcgttgctcttttaagaggtgtccagtgtcaagtgcaactggtggagtcgtgggggggggctggtccagcctggggaggtccctgagactctcctgtgcaggctctggattcaccttcagtaacgtacggcgtgcgacgtcgggtcccgaccaggcctaccgaggacgtaaggggtcgttgggagtggcgttggtacttaggtttcttacattacggtaaggtaaacggttagttacttaactaacgttaactacgtaacgacgtaccgtacggacggacggtcctactaccaccactccacgaataacaactaacgtaacaaacgacgtaactagtaacgtactagaacgaacgtacggtaacgaacgtacgtaacgtaaggtacggtaggtacgttaccgttaacgtttaagttaaacgtaacggggtaaacgggtaaaggggtaaacggggaacgggtacggtaacgtaggtaccggtactaaacgtaccggttaaagtttaaacggtttaccgtacgggtttccggaaccgggttaccggggtaccgggtaaccggtaccggttaaccgtccggtaccctacccgttcctacccgaacccgtccgtaacccgtaacccggtcccgtacccgttaccgttcccgttacccgttcccgacggttccgacccgttccgaccgaacgccgaacggtcccgtaaccgaccgggtacgacccggtcggacccgtcgggaccgtacccgggtggtaaccggtccgg

SEQ ID NO: 102169 - DNA, 735 bp, Homo sapiens
  misc_feature: GYAE6OF02I3VVU.9.33.C11.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagngtcgtacccaccgtagttacgcctggtaacccaacaccaaacctcggaccacggcctacccgacggcccctacgtacttcgtttgatcgacactccagtcgacgggtaccacgtcggccacgtacccacgtccgtaggttccaggtcggtaccgtaggttcgggtcgtaggggtaaccagttaccttcgaccttcctacctaacctactaccgacgtaccgtaacgacccgtaagaccgtaccgtaggtaagtttacgttttacgacgtttaaagttttacttaccgttacgttaacaaacttaccggttaccggtaaccggtacggtaccggggtccccgggttaccggggtacccttaccggtttcccgggacccggttacgggaaaccttaaacgtcgtaacgaacgttaaccgaaccgttaggtaccgtggtaccgtacgtacctaaccgttacgtcgtttaccgtacctttacccacgtttaccccgttccgtaaccc

SEQ ID NO: 102170 - DNA, 641 bp, Homo sapiens
  misc_feature: GYAE6OF02IOCCW.9.33.C11.1.454.CMB.1.raw
  modified_base (257)..(257): a, c, t, g, unknown or other
  misc_feature (257)..(257): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
tcagtgatacgtctcacgaccggtgctcgatttagagtgagctcgttgggttttcctcgttgctctttaagaggtgtccagtgtcaagtgcaactggtggagtcgtgggggggggctggtccagcctggggaggtccctgagactctcctgtgcaggctctggattcaccttcagtaactacggcgtgcacgtcgggtccgcaggctccgaagggcaagggcttgggagtggctggctagttgttcatctagaaggnttgtacaatactatacagactccggtagaacgggccgtaattcacctatcctaccagacgaacaacttacaaaggaacaacgatgtactactagacaaagtcggaacagaccgtaagaggttagacggacgacggtcttagtttaattacgtagtaaacggaaagggtacggggtaatacgaggtacggacaagacctacgtaaagttacttacgttaggtacttacggtgggaccgtaacgggtaacctggtacctaccgtctccgtcacgtcctacgaaccgaacggcctacgtccgtacccttcccgngaccnccgtacgtccaccggtacgaccgcctacccgtacggacgaccgtacgacgaccgggccgccgtacggg

SEQ ID NO: 102171 - DNA, 733 bp, Homo sapiens
  misc_feature: GYAE6OF02G6U83.9.33.C11.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccgganagattgtgttgacacagtctccagccaccctgtctttgctccaggggaaangccaccctctcctgcacgggccagtcagagtcgttaccacctagttacgcctggtaccaacacaaacctggaccaggcctacccacggccccctacgacttcgtttgacttcgcctatccctagttcgacggggcccaacgtcggaccactccccgagcccgtaggttcgaggtcggcgtaggtcgggtccgtggggaacagtaccgtttcaacttccgtaccaccctatccgacgtacgaacgaccttacgacggtacccttaggtaacttagttttcgtaacgtttaaggttttaccttacgttacggttacctaaacttcgttaccggtaaacggttccgggtaccggtcccgggtacccgggggttacccttaaccgggtttccccggacccggttaaccgggtaaaccgttaaaggttcgtaacgtactaaccgtaaaccggtacgttacggtacggtactacggaccctaccttaacggttcctttacggttccctttacctccgtttaccccgttcccggtaacc

SEQ ID NO: 102172 - DNA, 650 bp, Homo sapiens
  misc_feature: GYAE6OF02FQQ1Q.9.33.C11.1.454.CMB.1.raw
  modified_base (185)..(185): a, c, t, g, unknown or other
  misc_feature (185)..(185): n is a, c, g, or t
  modified_base (395)..(395): a, c, t, g, unknown or other
  misc_feature (395)..(395): n is a, c, g, or t
tcagtgatacgtctcacgaccggtgctcgatttagagtgagctcgttgggtttggggtacgatttgatgttacctgatgcttagaggcttttcctggaaagcagggcatttgttgcttcagcaccgtagtcgcctcgtcatcacgcctcagccttgattttccggattttggcctaggaaaaccngcctacccgcttaaaccgggacaaccgtcgcccggcaacatacgccttctcccgtcccccttcgcagtaaccaccaagtacaggaatattaacctgtttcccatcgactacgcctttcggcctcgccttaggggtcactcacccgtcgccccgattaacgtggacacggtaccttggtcttccggcgacgcggtctttcgccgtctttancgtttacttatgtcagctagtcgctacttctgactcctcagcactcgtcctcaccagaccacctaccttacacgtaccggtacttaacaacggaaccctcccgtaccccctaaacccgaaccaaccactaagtaacgtcgcgcgtccgcccgcgtacgtcgttccgggtactcgtagttccgggttttaccgccccgtttaccgtccgttcccttcccggacctcctaccggtacgtaacggtaccgttataccg

SEQ ID NO: 102173 - DNA, 718 bp, Homo sapiens
  misc_feature: GYAE6OF02H55YL.9.33.C11.1.454.CMB.1.raw
  modified_base (191)..(191): a, c, t, g, unknown or other
  misc_feature (191)..(191): n is a, c, g, or t
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (582)..(582): a, c, t, g, unknown or other
  misc_feature (582)..(582): n is a, c, g, or t
tcagtgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagtccttgtactttttccggtattttcgccgtagggaaaaaccncgccctacccggacgttaaaacccgggacaaccggtccgcccggccaaacatagccttctcccgtccccccttgcacgtaacaccaaatacaggaattacttaacctgttccatcgactacgtcctttcgctcgccgttagggcactccacctcgaccctattaacgttgacacggtacctggtctccggngacgcggtcttccaccgtctttagtcttacttatcgtnagactatcgactacttananaccttaccncatactatccgtacctcaacgactacaccctacgttacaacggtagtaccttacgaacgtaacctccctaacccctaacccaaacgaacctaccgaaaattaaccggccgtacccgtaccgcggtaccccganaaccgtttcgttacgggtactaccgttaacggtttacggttttaccccggtaccccgtttttaccgacccgttttacccgtccccccgttaacgtacgtttacctaaccggtaacggttacccgttagtaacccgg

SEQ ID NO: 102174 - DNA, 865 bp, Homo sapiens
  misc_feature: GYAE6OF02F5Q8D.9.33.C11.1.454.CMB.1.raw
  modified_base (152)..(152): a, c, t, g, unknown or other
  misc_feature (152)..(152): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagatacccaccgganagtattgtgttgacacagtcctcagccaccctgttctttcgtcctaccgaaggggaaagcgcccaacccgttctcccgtggacctaacgggccagtcgaagagttcgttaacccacccgtagttaacgcccttcggtaacccaacaccgtaaaccgtggcccaggccctacccgacggtccccctatattccgtttagagttcgctagttacccagtccgacgggtacccaacgtcgggaccctaacgtcccccgaaaggtcccgtaacgggttccaacgggttcggaacgtaacggggtttcggtccgttaacggggaacctaacgggttacgtttaccgtaacgtttccgttacccaaccgttacaaccgtacgaaccgtagtccccgttaaaggtaccgtaccgttaagtaaacgtacgtttttacggaccttaacgttttacttacgtacgttaaaccgtacgttaaccgttaccggttaaccggtacggtacggttacccgggtacccggggtacctttacggtttaccccggaccgttaacgggtaaacccgttaaaagtttacggaaacgttaaccttaaccggaaaccgttaccggtttacggtaacggtacccggttacgtaacccggttaaccttaacgtttcccgttaccggtttaacccttttccggaacccgttttcccccggttaacccgttaacccgg

SEQ ID NO: 102175 - DNA, 872 bp, Homo sapiens
  misc_feature: GYAE6OF02HPIRE.9.33.C11.1.454.CMB.1.raw
  modified_base (211)..(211): a, c, t, g, unknown or other
  misc_feature (211)..(211): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgaccacgagtcctccagccctaccctgttctttgtcctccgaggggaaanacgccacccgtctcctgaccgagggcccagtcgaaggtagtcggttaacccaccccgtaagttacgcccgttaggtaaccccaaacctaaccgaaaaccgttcggacccaagggtacccctaccccgaaccggtcccccctcgttaaaccgttccgttttcggaactcggtaaccctacgttcccctaaagttcccggaacggggccccctaacggtttggaacccctaaccttacccccgaacggtcccgtaaccgggttttaccgaagggttaccgggtcgtaacgggtttcgggggtccggtaacgggggtaaccaacggtttaaccctttaccgtaccccttccgttacccaaacccttagtcccgaacgtcccgtaaccgccgttaacggactccgttaaaggtaacgttagtttcgtacgttacgttttactaacgtttcgtaacctaacctagttaccgtaaccggtccgggttaccggtcccgggttcccggggttaccttaccgggtttaccccggcccggttaacggtaaaccctaaaggtttcgaaagttaccgttaacgaacggttaacgtcgtacgggttcctacggaaccctaacggtctttaccggttcttccgtttctaacccgtttccccgtaccccgtaaccg

SEQ ID NO: 102176 - DNA, 596 bp, Homo sapiens
  misc_feature: GYAE6OF02GFHNC.9.33.C11.1.454.CMB.1.raw
  modified_base (278)..(278): a, c, t, g, unknown or other
  misc_feature (278)..(278): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
tcagtgatacgtctcacgaccggtgctcgatttagagtgagctcgttggggtttggggtacgatttgatgttacctgatgcttagaggcttttcctggaagcagggcatttgttgcttcagcaccgtagtgcctgtcatcacgcctcagccttgattttccggattttgcctggaaaaccagccctacccgacttaaaccgggacaaccgtcgcccggccaacatacgccttctcccgtcccccttcgcagtaacaccaagtacaggatattaacctnttccatcgactacgccttcggcctcgccttagggtcactcaccctgcccctattaacgttgacaggtaccttggtcttccggcgaggcggtcttttcgaccgtctttatcgttacttatgtcagctatttccgctacttctagacttaccctcacgcagtcgcctcacagccacctcctacaccgacgtactacgactaccgcctcccaaccaaccacactactaacgcgtcgctcgcgtacngtctcggtanctacggttcggtttacctccctttactaccttccctccgactactcgtaacacggtactataccg

SEQ ID NO: 102177 - DNA, 768 bp, Homo sapiens
  misc_feature: GYAE6OF02HRF7F.9.33.C11.1.454.CMB.1.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtcctccagccaccctgtctttgtctccgaggggaaancgccaccctctctgcaggccagtcagngtagttaccaccagttagcctggtaccaacacaaaccgtggccaggcctccgacggcccctnacttcttgatcgcactccatcgaggaccacgtggccaacgtcccagccgtacggtttcgacggtcggcgtacggttacgggtcgtacgggtacgacgttaccttcgaccttcaccgtacctacgtccgacgtccgacgtacctacggacgtaccgttaggtaaacgtttagtttttacgtaacgtttaacggttttaacgttaccgttaacgttaaccgttaaaccgtaaccgtttaccgggtaacccggtacggttacccggggtacccggttcccggggggtaccctttacccgggttacccgggtaacccggttaccgggtaaaaccgttaaaacgtttacggaaacgtaaccgttaaccgtaaaaccggtacgtttacgggtacggtacccgtaggaacccgttaccgttaacgttccgttaccggttacccgtttaaccgttacccgttttcccgtaccccgttaaccg

SEQ ID NO: 102178 - DNA, 719 bp, Homo sapiens
  misc_feature: GYAE6OF02H0ET8.9.33.C11.1.454.CMB.1.raw
  modified_base (175)..(175): a, c, t, g, unknown or other
  misc_feature (175)..(175): n is a, c, g, or t
  modified_base (235)..(235): a, c, t, g, unknown or other
  misc_feature (235)..(235): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (623)..(623): a, c, t, g, unknown or other
  misc_feature (623)..(623): n is a, c, g, or t
  modified_base (674)..(674): a, c, t, g, unknown or other
  misc_feature (674)..(674): n is a, c, g, or t
tcagtgatacgtctcacgaccggtgctcgatttagagtgagctcgttgggtttgggggaggaacgtgctcagttaggaccagagggaaccataggaagccccagctcagccttctcttcctccgctactcctggctccagataccgaccggagagattgtgttcgacacgagtcncacgccaccctgttcctttcgtcctaccggaagggaaacgacgtccctaccctcttccgngcgacgggccagttccgaagtacgtacgttacaaccgacgtacgccgttaacgaacaaccaacaaacctcggaaccgcggacctccgaacggtcccctcactcgttnagtcgacacgtcaancgtaacggcacggtcnccgactacccgagtcccgtaagtcgtaacgtcggagtcggtacggtgtacggggaacacgtaacttcgtctactccgaacctaggtacaggcctaacggctaagacgtacgtagaaagttgttatcgttaacgtttactaacggtttcaaacgtaccgttaacttaccggaacgttcggttacggacccggtccgggtacccttaccggttacccggaccgaacgggttaaccttaaagtaaccgggtanaacgtaaacgtaaccgacggttagtacggaacgttcgacctacgtaaccgngttaccggtttcctaccgtttaccgtcccgttaccgacgttaccg

SEQ ID NO: 102179 - DNA, 735 bp, Homo sapiens
  misc_feature: GYAE6OF02HX5DM.9.33.C11.1.454.CMB.1.raw
  modified_base (145)..(145): a, c, t, g, unknown or other
  misc_feature (145)..(145): n is a, c, g, or t
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (325)..(325): a, c, t, g, unknown or other
  misc_feature (325)..(325): n is a, c, g, or t
  modified_base (697)..(697): a, c, t, g, unknown or other
  misc_feature (697)..(697): n is a, c, g, or t
tcagtgatacgtctcacgaccggtgctcgatttagagtgagctcgttgggttgggggaggaactgctcagttaggacccagagggaaccagtggaacgccccagctacagcttcctcttctcctgactactcgtggcctaccganactaccacggagacgtattgtagtgacacgagttccnccagtcccacctgttcctttgctacgaaggggaaancgccctacctcgtccngcgaggccagtcaggtgtacgttaaccaccgtagttacgcctaggaaccaaacaccaaacgtcggaccacggtcctacccgacggcccctntaaccgttccgtttagactacggcaacgttccgaacgttacggacggtccaacgttacggactacccttcccgaagtaccgtaacggttacgaacggtgggaactacgggttcggtactaggggaactacggtactttacacggtcctacaaccgactcggagtacctaactacgacgtacgtccgtaaggaattacgtttcaacgttaacgtttagtacgttacgtaacgtaaccgtagttacccgtaagacggtccggtacccgggtacgggtaccgttaccgttccgggaccgtaacgggaaaccttaaggtacgaagtaacccgtaacgaacggttaacgtcggaacggtcgtacgaaccggttaacngttacgtacgttaccgtactcctacggttccctaacgg

SEQ ID NO: 102180 - DNA, 718 bp, Homo sapiens
  misc_feature: GYAE6OF02GU2RI.9.33.C11.1.454.CMB.1.raw
  modified_base (443)..(443): a, c, t, g, unknown or other
  misc_feature (443)..(443): n is a, c, g, or t
tcagtgatacgtctcacgaccggtgctcgatttagagtgagctcgttggggtttggggggaggaactgctcagttaggacccagagggaaccatggaagccccagctcagcttctcttcctcctgctactctggctccagataccaccggagagattgtgttgacacagtctccagccaccctgtctttgctccgaggggaaagacgccaccctctcctgcagggccagtcagacgtcgtaccaccagttacgccgtacggtaaccaacaaccaaaaccgtcggaccaaggcctacccgaccgggtacccctactattccgtttagaacttcgacctaactacccaagtaccggaacggggacccaacgtcggactaactcccgacggccgtaggttacaggtggcgaggttcggggtctaggggactacggacttcacttcnccaacactacgagacacgactagacgctagtaagtatttagtacttagttaacgttacgttacgtaactaactaacgttaccgtaacggtacggtacgggtcccgggttacccgggggaacctttaccgggtttacccgggtacccggtaacgggttaaaccttaaacgttacggtaaacgtaacgtaaccgaaacgttaacggttacggtcggaacggttacgtaccgaaccttacgtacgttacttaccttactaccgttacctaccccgtac

SEQ ID NO: 102181 - DNA, 957 bp, Homo sapiens
  misc_feature: GYAE6OF02GGGTW.9.33.C11.1.454.CMB.1.raw
  modified_base (125)..(125): a, c, t, g, unknown or other
  misc_feature (125)..(125): n is a, c, g, or t
  modified_base (469)..(469): a, c, t, g, unknown or other
  misc_feature (469)..(469): n is a, c, g, or t
tcagtgatacgtctcacgaccggtgctcgatttagagtgagctcgttggggtttgggggaggaactgctcagttaggacccagagggaacctatggaagccccagctcagcttctcttcctcctnctactctggctcccagactacccaccggacgagtattgttcgttggaccactagtcctacccagccctaccccttgttccttttagtccgttaccgaagggggtaaaacgacgacccctaaccccgttccttcccgttcggccgggtacgggccctaggtccgagtaaggtcgtttaacccaccccgttaggtttaacgcccgttacggttaacccaactaaacctaaaccctcgggacccgacggccctaccccggaaccggcccccttacctaactttcgtttacgtaacttcgaccttactccctaacgtaccggacgggtacccaccgtcgggaaccccncgttaccccgacggtccgttaccgggttctacgggttaccggtccgtaggtttcgggggtacgttacgggtaaccgtaacggttacccttacccgtaacgttaccccgtcctaaccgtaacctccgaaccggtacctaaccggtaccgtaacggtaccgggtactttacgggtaaaaggtttacctttttacgggtaacgtttttaacggttttaaacctttaccgttacggttaacctaaaccgttacggtttacccgtacggggttaccggtccgggttccccggggtaccggggttacccctttaccgggttcccgggtacccggtaacgggtaaacccgttaaggttaacggtaacgtaaccgttaaaccggagttaccccggttggttaaccggacccgttacgtaaccggaacccgtttatttaccccggttacgttttaccgtttaccgttaacccgtttccccggttacccgttaaccgg

SEQ ID NO: 102182 - DNA, 667 bp, Homo sapiens
  misc_feature: GYAE6OF02HN8B5.9.33.C11.1.454.CMB.1.raw
  modified_base (143)..(143): a, c, t, g, unknown or other
  misc_feature (143)..(143): n is a, c, g, or t
  modified_base (177)..(177): a, c, t, g, unknown or other
  misc_feature (177)..(177): n is a, c, g, or t
tcagtgatacgtctcacgaccggtgctcgatttagagtgagctcgtggggagaggagcccagcactagaagtcggcggtgttccattcggtgatcagcactgaacacagagactcacatggagttggctgagcttgggtttcncgttgctctttaagaggtgtccagtgtcaagtgnaactggtggagtcgtgggggggctgtcagcctgggcgtcctgagctctccgtgtgccgaggtctcgtaggtattcaacccttgaagtaaccgttacgggcgtagccgtacggtcggggtccgccgtaggccgttaccgaggccgtaaaggggtcttagggacgtacgggccttaggtcctaaggtttgtttcaacgttagtagggaaaggtaaagttcgttaaccaagtttaactaagtaacgtacggtacctccgggtaagaaacgggccttaacgtacacgtaacgtcctacgtaacgaagtactaacgtactaaagaacagatgaactcgtagacaagtcgaacacgtaactaacgtagtacgaacgacgtacggacttaagtttactacgtaacgggttaacaaacggggaggggtactaacgtaggtacggactacggtaacctcgaacggtttaccgttaaccgtagtaccgttagtaccgggg

SEQ ID NO: 102183 - DNA, 805 bp, Homo sapiens
  misc_feature: GYAE6OF02GR02A.9.33.C11.1.454.CMB.1.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagtattgtgttgacacagtctccagccaccctgtctttgtctacgaagggaanacgcccaccctctcctgacgacgggccagtcagtagtcggttaacccacctagttacgccgttacggtaaccaaacacctaaaccgtcggaccacggccctacccgaccggcccctacagtttcttacgtatacgacctactacctacgtccgacgggtaccctaccgtggtacctaccgtccccgtagtacccgttacggttacggtaggtccgggtacgtagggttccggggtagtacgggtacgacgttacctaccgtacctccctaccgaaccctataccgtacgacccgtacggtacctaacggaccggttaccgtaagtggtttaaacgtttgtaacttacggtttttaccaacgtttacgttaacaaacgtttcgtaaccgggttacccgtacgggtcgggttccccgtaccgggggtttacccttacggggtttacccgggtacccgtaacggggttaaacccttaaagggtagtaaaccgtaacgtaaaccggtaaccggttaccttagggttacgaccctttggaaccccggttactaccgtttagggtttccttacccgtttaccgtacccttcccggttcctaaacccg

SEQ ID NO: 102184 - DNA, 633 bp, Homo sapiens
  misc_feature: GYAE6OF02HO6Z0.9.33.C11.1.454.CMB.1.raw
  modified_base (283)..(283): a, c, t, g, unknown or other
  misc_feature (283)..(283): n is a, c, g, or t
  modified_base (431)..(431): a, c, t, g, unknown or other
  misc_feature (431)..(431): n is a, c, g, or t
tcagtgatacgtctcacgaccggtgctcgatttagagtgagctcgtggggaggaggagcccgagcactagaagtcggcggtgttccatcggtgatcagcactgaacacagaggactcaccatggagtttgggctgagctgggttttcctcgttgcttctttaagacggtgtcccagtcgtacaagtgccaactcggtggagtcggtggggggggctggtccaggccgtgggacggtccctggacgcctcgtccgtgtgcaggctcgtggtattccaccctttnaagtaaccgtacggcgtgctacggtcgggccgcgaggtcctaccgagggacgaaggggtccttaggagtcggcgtggctaggtttcgttacagtcgtaggaaggtatgtacaatactatacagactcgaggaacggctatcactatcncagacgacaactacaaagacagatgtatctagactaaagtcgaacacgtaacgtaagtacgttaggaacgaccgaacggttcgtttagtttaacgttaacgtaggtaaacgggtaagggaagggggtaatcggaaggtacggtacgacgtaccgtaacgtaacggttaccttacgtttacgaccgtttacgggtaaccgggg

SEQ ID NO: 102185 - DNA, 639 bp, Homo sapiens
  misc_feature: GYAE6OF02HO2SK.9.33.C11.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctcccagataccaccggagagattgtgttgacacagtctccagccaccctgtctttgtctccgaggggaaangccaccctctcctgcagggccagtcagagtcgtaccaccagttancctggtaccaacacaacctggccaggctcccaggcccctnatcttgactgacactccataccgagggcccactggcctaactccccagccgtagttcaggtcggctaggtggtcgtgggacacgacttcactctcaccatcagcacgcctagacgtcctagtaagtatttagacgttagttttacttactacgttactaacgtacttaccggtaaccgtacgttcgggtaccggttcccgggggtaccttaccggtttcccgggacccgtacgggtaaacccgtaaagttacgaacgtaacgtaaccgaaacgtacggtacggtcggtaccgtaggtaccaccgtaacttccgttacgttaccttacctaccttcccgttacccgtacc

SEQ ID NO: 102186 - DNA, 770 bp, Homo sapiens
  misc_feature: GYAE6OF02G0CI4.9.33.C11.1.454.CMB.1.raw
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
tcagtgatacgtctcacgaccggtgctcgatttagagtgagctcgttgggtttgggggaggaactgctcagttaggacccagagggaaccatggaagcccagctcagcttctcttcctcctgctactctggcctacccagactaaccgaccgggaagtagtattggtgttagacaactagtcctaccagccctaccctgttcttttgaccgtaccgaaggggaagcgaccctaacccgtcctcctcggacgacgggtccacggtcagtacggttacgttaacccacccgttaggttacgccgttacggtaaccaaacaccaaaccgtggcccgaacggtcctacccgacggtaccccctatacttcttagactcgactactacaactacggacggtcctagtcggtaccacgtaccgtcgacgtacggtanacggtcgacgtaggtcgggtacgnggacgtagtctacgacctcactacactcgacgtacgtacgactacgtacgccgttaagacgttaagttacgaacgtttaacgttttactacgtacttaacgtaaaccgttcgttaaccggtacggtcggttaaccgggcccgggttacccggggtacccttacgggtttacccggaaccgggtaacggtttaaaccgtaaaggttcggaaaaccgttacgtaaacccgtaaggttaccgttacggggtaccgagttaaccacggtaccgttactaccgtttcttaccgaccgtttaccgttccctaacccggtac

SEQ ID NO: 102187 - DNA, 661 bp, Homo sapiens
  misc_feature: GYAE6OF02FSB5B.9.33.C11.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagtgatacgtctcacgaccggtgctcgatttagagtgagctcgttgggtttggggggaggaactgctcagttaggacccagagggaaccatggaagccccagctcagcttctcttcctcctgctactctggctcccagataccaccggagagattgtgttgacacagtctccagccaccctgtctttgtctccaggggaangccaccctctcctgcagggccagtcagagtgttaccaccagttancctaggtaccaacacaaacctggccaggcctcccgacggccccctcattcttgatgcatccatcgacgggaccacgtcggacactacccgagacctaggttccaggttggccgtaggtcgggtgttcgggactacggtacttacgctcctcaccactcgacgaccagccgtaagacgtccgtagtaagtactttgcgttaagttttatacgtctaacaactataccggttaacgtacggtcgggtacccggttccggggtaccgttaccggttttcccgggacccggttaacgggtaaacccgtaaagttaccggtaagacgttaacgaaaccgttaagtacgggttcggtacgtacgtaccgaacctagttcttccgttacgtttacccacgtttacccttaccccggaacc

SEQ ID NO: 102188 - DNA, 759 bp, Homo sapiens
  misc_feature: GYAE6OF02G7Z76.9.33.C11.1.454.CMB.1.raw
  modified_base (530)..(530): a, c, t, g, unknown or other
  misc_feature (530)..(530): n is a, c, g, or t
  modified_base (719)..(719): a, c, t, g, unknown or other
  misc_feature (719)..(719): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggcctccagactaccgacggagagagttgtgttagacacagtctccagcccaccttgttctttgtcctaccggaagggaagcgacccaccctctccgtgcgacgggcctagtcaggtacgtacgttacccaccgtagttacgccgtacggtaaccaacgaaccaaaccgtcggacacggccgtacccgaccggccctactacttcgttcgagtcgacctactccgaacgttaccggacggtacctacggtcgacctaccgtacccgacggtccgtacggttcgtacggtaggtcgtagggtcggtcggtacggtacgtacgttaccttccaccgttactaccgtacctacgtaccgacgtaccaccggtaacctacggactaccgttaggtaacgtttnttaccggtagtttaagtttactaccgttagtaccgtaacttacggtacccgtagtaccggggtccgtcccggggttaccgggtccctttaccgggttcccgggaccgttaacggtaaaccgtttaaggtcggtaacgtaaaccgtaccggtaaacgtcggttacgtcggtactaacggcccgtacgttntttccggttacttccacccgttacgttccccgtacctacg

SEQ ID NO: 102189 - DNA, 753 bp, Homo sapiens
  misc_feature: GYAE6OF02IIV0M.9.33.C11.1.454.CMB.1.raw
tcagtgatacgtctcacgaccggtgctcgatttagagtgagctcgttgggtttgggggaggaactgctcagttaggacccagagggaaccatggaagccccagctcagcttctcttcctcctgctactctggctcccagactaccaccggagagtattgtgttgacacagtctccagccctaccctgttctttcgtctaccgaaggggaaagacgcccaccctctcctgcgacggccagtcagtagttctacccacccgtagttacgaccgtagtaacccaacaaccgaaaccgtggaccacggtcctcccgacggtcccctacactttcttaggctgacctacgtccacgtccgaccgggacctacgtacggcctaccgtacccgaacgtccgttaacggttcgtaggtcggacgtacgggttcggggtcgtacgggactacggtactaccgtaccttcctaaccgtaaccacgttaccgaacgccgtaacgtaccgtaggtaccgtcgtaaggtaagtttctttacgactttaagttttactactacgttaactaacgtcgttaccgtaccggtagtccgggtacccggttccgggtaccttaccggttacccgggaccgttaacgggaacccttaaaggtccggtaacgtaacgtaaccgtaacgttacggtacgggtacgtaccgtacgtaacccgacgttacgttccgtacgtttaccttacccggttacccttcccgtacccgtacg

SEQ ID NO: 102190 - DNA, 728 bp, Homo sapiens
  misc_feature: GYAE6OF02FYM1J.9.33.C11.1.454.CMB.1.raw
  modified_base (160)..(160): a, c, t, g, unknown or other
  misc_feature (160)..(160): n is a, c, g, or t
  modified_base (470)..(470): a, c, t, g, unknown or other
  misc_feature (470)..(470): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
  modified_base (676)..(676): a, c, t, g, unknown or other
  misc_feature (676)..(676): n is a, c, g, or t
  modified_base (688)..(688): a, c, t, g, unknown or other
  misc_feature (688)..(688): n is a, c, g, or t
  modified_base (694)..(694): a, c, t, g, unknown or other
  misc_feature (694)..(694): n is a, c, g, or t
  modified_base (707)..(707): a, c, t, g, unknown or other
  misc_feature (707)..(707): n is a, c, g, or t
  modified_base (712)..(712): a, c, t, g, unknown or other
  misc_feature (712)..(712): n is a, c, g, or t
tcagtgatacgtctcacgaccggtgctcgatttagagtgagctcgttgggttttcctcgttgctcttttaagaggtgtccagtgtcaagtgcaactggtggagtcgtggggggggctggtccagcctgggaggtccctgagactctcctgtcgcaggctntggattcaccttcagtaactacggcgtgctacgtcgggtcccgccgaggtcctcccgagggacctaacggggtctttagggagtgggtccgtggtaccgtaggttttcgtttaccacgttccgtaggtaaacgggttaacggttcgtttaaccaaaacttaaccttaagtaaccgtaaaccggtaccggttacccgggttaagggaaaccgggggtccccgtaactttacccggacccttaacttcccgtaccgaacggaacgtaacctaacgtttaccgaaacgtaacgaccgtatacgtactccgtanacgaagtcgaacncggtactaagnggttacgacggactacggtnttagttaacgtagtaacgtacggaagggtagggtactaggtcggagactacgactacgtaacgttacttattcgacggttcggtacggtacgtaccggtacgtcgtaccgtaccgtctaccgctactcctacccacgcgccttcgtccgtcctccgcgtccnccgtacgcgacncgtacnccgaccgtcgacncgacncgacgtccgaccgtcg

SEQ ID NO: 102191 - DNA, 736 bp, Homo sapiens
  misc_feature: GYAE6OF02JRAOZ.9.33.C11.1.454.CMB.1.raw
  modified_base (169)..(169): a, c, t, g, unknown or other
  misc_feature (169)..(169): n is a, c, g, or t
  modified_base (536)..(536): a, c, t, g, unknown or other
  misc_feature (536)..(536): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggcctccagataccaccggagagtattgtgttagacacngtctccacgccctaccctgttcctttcgtcctaccgaaggggtaaacgcgaccctacccttccgtccgtagaccggacggccgtagtacgaacgtacgttaccgtaaccccgtacccgtaacggttccgtacccgttaacggaacccaaaccgaaccgtaaaccggttcggaccgtacggtaccctaccccgaccgtccccctacttacgttcgttacgactcgacctacctacgtacgtaccggtccggaccgtacgtaccggacctacctaccggtacggtacgtacggtccgacggtcggtacgtacgggtacggtcgacgggactcgttaccgtcactaccacgactcgactacgacgtaacncgtaacgctacggttaactagttcttacgtatttaccgtaatacgtattacctacgtaccgtccgttacgggaccgtccggtaccggttactacccgttacggtaccgccgtaagtaaccgtagtacaacgacgttacgacggttgccgtatactccctagtacgttcctcgttacctcgtacctaccgtacgtctaacg

SEQ ID NO: 102192 - DNA, 701 bp, Homo sapiens
  misc_feature: GYAE6OF02G28OE.9.33.C11.1.454.CMB.1.raw
  modified_base (171)..(171): a, c, t, g, unknown or other
  misc_feature (171)..(171): n is a, c, g, or t
  modified_base (324)..(324): a, c, t, g, unknown or other
  misc_feature (324)..(324): n is a, c, g, or t
  modified_base (436)..(436): a, c, t, g, unknown or other
  misc_feature (436)..(436): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagactaccaccggagagtattgtgttcgacacngtctccagcccacccttgttcctttgtccgtaccgaaggggaaagcgcccaccctctccgtgcgacgggcagtcagtagtcgtacccacctagttacgccgtacgtaacccaacaaccaaccgtcggacacggtcctcccgaccggtcccctntacttcttgatcgctactccatcgacggccacgtgaccactccacgtaccgtggttcaggtcgcgtagggtcggtcgagggactacgtacctcgtacctcgtccaaccgtanacgaccacacgtccagtacgccgttaaggtactttatttggactttagtttaactacgtagtaccaaagtcgttacggtacgtcgtccgggacccggttccgggtaccttacccgggtttccgaccgttaacgggtaaactaacggtttgaaaccgttacaacccgggtaagtacgttcgggtcggtacccgtacgtaacccttacggtagtttcccggtttcttaacccgtttacccgaccgttttcccccggtaaccctaccg

SEQ ID NO: 102193 - DNA, 919 bp, Homo sapiens
  misc_feature: GYAE6OF02GN9F4.9.33.C11.1.454.CMB.1.raw
tcagtgatacgtctcacgaccggtgctcgatttagagtgagctcgtgggagaggacgcccagcactagaagtcgcggtgtttccattcggtgatcagcactgaacacagagactcaccatggagtttggctgagctgggttttcctcgttgctctttaagaggtgtccagtgtcaagtcgcaacgtggtggacgtcggtggggggggtactggtccaggccgtgggtacggtccctaggagtactcgtaccttggtacgcaggtcctcgtaggacttccgtaccgttacaacgtaacgtaccgggtcgttacgaccacggttgggtaccccgaccgtaaaggtcccttaaccgaacgggtaccgtaaaacggggtccgtttaggggaacggttcgggacccggttacgggacgttaaccggttttaggttttaccaaacggttcgttaacgggaaaacggggttaacgtttagggttaacctaaaacgtttaaccgttaaacgttacccggtaaaacggtaacccgtttccgggtaaaggggaaaccggggtccgttaaacgtttaccccgaaccgttaacgtttacccgaacggtaaacgtaacgtaaacccgtaaccttaacccgaaaaggtaacccgaacgttaacgtacgttaattaccgtacgtaaaccgaaaggttacggaaccgtaaacgtaacccggttaaagttaccgggttaaggaaaccggtaccggtaccggtttaaccgtttacggttttaaccggttaaagtaaccgggtaaaccgggttaaaggggacgggttaaaaccttacggggtaaggttaacccgggaaccgttaaacgtaccccgtttaacggtaaaccgtttacccgtttaacggttttacggaacccgttttacgggaacccgggg

SEQ ID NO: 102194 - DNA, 261 bp, Homo sapiens
  misc_feature: GYAE6OF01CHSHF.11.37.D04.1.454.CMB.1.raw
  modified_base (261)..(261): a, c, t, g, unknown or other
  misc_feature (261)..(261): n is a, c, g, or t
tcagcgagagataccacgaccggtgctcgatttagtagcatactgttgggtttgggggacagatttcaccctcaccatcagcaacctgcaggctgaagatgtggcagtatattactgtcaccagtattttgatgtttctaatccggcgaccttcggccaagggaccagggtggaaatcaaacgaactgtggctgcaccatctgtcttcatcttcccgccatctgagtatctctcgctgagcgggctggcaaggcgcatagn

SEQ ID NO: 102195 - DNA, 257 bp, Homo sapiens
  misc_feature: GYAE6OF01EKA3Y.11.37.D04.1.454.CMB.1.raw
tcagcgagagataccacgaccggtgctcgatttagtagcatactgttgggtttgggggacagatttcaccctcaccatcagcaacctgcaggctgaagatgtggcagtatattactgtcaccagtattttgatgtttctaatccggcgaccttcggccaagggaccagggtgaaatcaaacgactgtggctgcaccatctgtcttcatcttccgccatctgagtatctctcgctgagcgggctggcaaggcgcatag

SEQ ID NO: 102196 - DNA, 264 bp, Homo sapiens
  misc_feature: GYAE6OF01DVKNH.11.37.D04.1.454.CMB.1.raw
  modified_base (261)..(264): a, c, t, g, unknown or other
  misc_feature (261)..(264): n is a, c, g, or t
tcagcgagagataccacgaccggtgctcgatttagtagcatactgttgggtttgggggacagatttcaccctcaccatcagcaacctgcaggctgaagatgtggcagtatattactgtcaccagtattttgatgtttctaatccggcgaccttcggccaagggaccagggtggaaatcaaacgaactgtggctgcaccatctgtcttcatcttcccgccatctgagtatctctcgctgagcgggctggcaaggcgcatagnnnn

SEQ ID NO: 102197 - DNA, 309 bp, Homo sapiens
  misc_feature: GYAE6OF01EP2WG.11.37.D04.1.454.CMB.1.raw
  modified_base (118)..(118): a, c, t, g, unknown or other
  misc_feature (118)..(118): n is a, c, g, or t
  modified_base (235)..(235): a, c, t, g, unknown or other
  misc_feature (235)..(235): n is a, c, g, or t
  modified_base (278)..(309): a, c, t, g, unknown or other
  misc_feature (278)..(309): n is a, c, g, or t
tcagcgagagataccacgaccggtgctcgatttagtagcatactgttggggtttggggggacagatttcaccctcaccatcagcaacctgcaggctgaagatgtggcagtatattacngtcaccagttattttgattgtttctaatccggcgaccttcggccaagggaccaggggtaggaaatcaaaacgactgtggctgcaccatctgtcttcattcctcccgctatctgagtntctctcgctgacggcgggctgggacaagggccgcaataggcannnnnnnnnnnnnnnnnnnnnnnnnnnnnnnn

SEQ ID NO: 102198 - DNA, 173 bp, Homo sapiens
  misc_feature: GYAE6OF02FQ8Y4.11.37.D04.1.454.CMB.1.raw
  modified_base (173)..(173): a, c, t, g, unknown or other
  misc_feature (173)..(173): n is a, c, g, or t
tcagcgagagataccacgaccggtgctcgatttagtagcatactgttgggtttgggggaagaggaagactgacggtcccccaggagttcaggtgctgggcacagcggccctgggctgcctggtcaaggactacttccgtatctctcgctgagcgggctggcaaggcgcatagn

SEQ ID NO: 102199 - DNA, 261 bp, Homo sapiens; identical to SEQ ID NO: 102194
  misc_feature: GYAE6OF02GDFAH.11.37.D04.1.454.CMB.1.raw
  modified_base (261)..(261): a, c, t, g, unknown or other
  misc_feature (261)..(261): n is a, c, g, or t

SEQ ID NO: 102200 - DNA, 262 bp, Homo sapiens
  misc_feature: GYAE6OF02IXI51.11.37.D04.1.454.CMB.1.raw
  modified_base (261)..(262): a, c, t, g, unknown or other
  misc_feature (261)..(262): n is a, c, g, or t
tcagcgagagataccacgaccggtgctcgatttagtagcatactgttgggtttgggggacagatttcaccctcaccatcagcaacctgcaggctgaagatgtggcagtatattactgtcaccagtattttgatgtttctaatccgacgaccttcggccaagggaccagggtggaaatcaaacgaactgtggctgcaccatctgtcttcatcttcccgccatctgagtatctctcgctgagcgggctggcaaggcgcatagnn

SEQ ID NO: 102201 - DNA, 309 bp, Homo sapiens
  misc_feature: GYAE6OF01B8F3S.35.37.D04.1.454.CMB.1.raw
  modified_base (274)..(274): a, c, t, g, unknown or other
  misc_feature (274)..(274): n is a, c, g, or t
  modified_base (277)..(309): a, c, t, g, unknown or other
  misc_feature (277)..(309): n is a, c, g, or t
tcagtacagatcgtcacgaccggtgctcgatttagtagcatactgttgggtctgggacgagacttcactctcaccatcagcagactggagcctggaggtacttttgcactatactatctgtcagtactatgataattcacccaatgtacacttttggtcaggggaccaagcctggagatctaccgaacgtcggtggctggcaccatctgtcttcatcttcccgcatcctagaacgatactgtaactgagtcgggctgggcaaggcgacactagncannnnnnnnnnnnnnnnnnnnnnnnnnnnnnnnn

SEQ ID NO: 102202 - DNA, 260 bp, Homo sapiens
  misc_feature: GYAE6OF01CZ0VG.35.37.D04.1.454.CMB.1.raw
  modified_base (224)..(224): a, c, t, g, unknown or other
  misc_feature (224)..(224): n is a, c, g, or t
  modified_base (256)..(260): a, c, t, g, unknown or other
  misc_feature (256)..(260): n is a, c, g, or t
tcagtacagatcgtcacgaccggtgctcgatttagtagcatactgttgggtctgggacagacttcactctcaccatcagcagactggagcctgaggattttgcactatatatctgtcagtactatgataattcaccaatgtacacttttggtcaggggaccaagctggagatctaccgaactgtggctgcaccatctgtcttcatcttcccgccatctgaacgntctgtactgagcgggctggcaaggcgcatagnnnnn

SEQ ID NO: 102203 - DNA, 261 bp, Homo sapiens
  misc_feature: GYAE6OF01BEUQL.35.37.D04.1.454.CMB.1.raw
  modified_base (257)..(261): a, c, t, g, unknown or other
  misc_feature (257)..(261): n is a, c, g, or t
tcagtacagatcgtcacgaccggtgctcgatttagtagcatactgttgggtctgggacagacttcactctcaccatcagcagactggagcctgaggattttgcactatatatctgtcagtactatgataattcaccaatgtacacttttggtcaggggaccaagctggagatctaccgaactgtggctgcaccatctgtcttcattcttcccgccatctgaacgatctgtactgagcgggctggcaaggcgcatagnnnnn

SEQ ID NO: 102204 - DNA, 316 bp, Homo sapiens
  misc_feature: GYAE6OF01D1TBN.35.37.D04.1.454.CMB.1.raw
  modified_base (92)..(92): a, c, t, g, unknown or other
  misc_feature (92)..(92): n is a, c, g, or t
  modified_base (178)..(178): a, c, t, g, unknown or other
  misc_feature (178)..(178): n is a, c, g, or t
  modified_base (208)..(208): a, c, t, g, unknown or other
  misc_feature (208)..(208): n is a, c, g, or t
  modified_base (272)..(316): a, c, t, g, unknown or other
  misc_feature (272)..(316): n is a, c, g, or t
tcagtacagatcgtccacgaccggtgctcgattttagtagcatactgttggggtctgggacagacttcactctcaccatcagcagactggancctgaggattttgcactatatatctgtcagtactatgattaattcacaatgttactactttttggtcaggggtacctaagctgganatctaccgatgtgctgcacatctgtcttcntccttccgctatctacgaacgtatctgtactggacgtcgggtctggacaacgggctactaatgnnnnnnnnnnnnnnnnnnnnnnnnnnnnnnnnnnnnnnnnnnnnn

SEQ ID NO: 102205 - DNA, 436 bp, Homo sapiens
  misc_feature: GYAE6OF01D6VNN.35.37.D04.1.454.CMB.1.raw
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (311)..(312): a, c, t, g, unknown or other
  misc_feature (311)..(312): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (351)..(352): a, c, t, g, unknown or other
  misc_feature (351)..(352): n is a, c, g, or t
  modified_base (354)..(355): a, c, t, g, unknown or other
  misc_feature (354)..(355): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (365)..(366): a, c, t, g, unknown or other
  misc_feature (365)..(366): n is a, c, g, or t
  modified_base (369)..(370): a, c, t, g, unknown or other
  misc_feature (369)..(370): n is a, c, g, or t
  modified_base (372)..(372): a, c, t, g, unknown or other
  misc_feature (372)..(372): n is a, c, g, or t
  modified_base (374)..(377): a, c, t, g, unknown or other
  misc_feature (374)..(377): n is a, c, g, or t
  modified_base (380)..(380): a, c, t, g, unknown or other
  misc_feature (380)..(380): n is a, c, g, or t
  modified_base (382)..(387): a, c, t, g, unknown or other
  misc_feature (382)..(387): n is a, c, g, or t
  modified_base (389)..(391): a, c, t, g, unknown or other
  misc_feature (389)..(391): n is a, c, g, or t
  modified_base (395)..(396): a, c, t, g, unknown or other
  misc_feature (395)..(396): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (409)..(410): a, c, t, g, unknown or other
  misc_feature (409)..(410): n is a, c, g, or t
  modified_base (413)..(413): a, c, t, g, unknown or other
  misc_feature (413)..(413): n is a, c, g, or t
  modified_base (415)..(416): a, c, t, g, unknown or other
  misc_feature (415)..(416): n is a, c, g, or t
  modified_base (418)..(420): a, c, t, g, unknown or other
  misc_feature (418)..(420): n is a, c, g, or t
  modified_base (422)..(423): a, c, t, g, unknown or other
  misc_feature (422)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
tcagtacagatcgtcacgaccggtgctcgatttagtagcatactgttgggtcgtgggacagacttcactctcaccatcagcagactggagcctgaggtacttttgcactatatatctgtcagtactatgataattcacaatgtacactttggcagggaccaagctggagatcaccgaactgtcgctgcaccatctcgtcttcattcctccgccatcctagaacgattccgtagtacgtcggaacggtcgggactacgggtacgaaacggtcgacctaagtagganacgtgcagactggcagtacagtcnanncncacactnactanactacangagacncacatagtangnngnngagngngngnnctnnanannnnctntnnnnnnannnagcnntanananacancnncgnannannnannananacancnngn

SEQ ID NO: 102206 - DNA, 260 bp, Homo sapiens
  misc_feature: GYAE6OF02HZ3XO.35.37.D04.1.454.CMB.1.raw
  modified_base (258)..(260): a, c, t, g, unknown or other
  misc_feature (258)..(260): n is a, c, g, or t
tcagtacagatcgtcacgaccggtgctcgatttagtagcatactgttgggtctgggacagacttcactctcaaccatcagcagactggagcctgaggattttgcactatatatctgtcagtactatgataattcaccaatgtacacttttggtcaggggaccaagctggagatctaccgaactgtggctgcaccatctgtcttcatccttcccgccatctgaacgatctgtactgagcgggctggcaaggcgcatagnnn

SEQ ID NO: 102207 - DNA, 265 bp, Homo sapiens
  misc_feature: GYAE6OF02FZW48.35.37.D04.1.454.CMB.1.raw
  modified_base (216)..(216): a, c, t, g, unknown or other
  misc_feature (216)..(216): n is a, c, g, or t
  modified_base (254)..(265): a, c, t, g, unknown or other
  misc_feature (254)..(265): n is a, c, g, or t
tcagtacagatcgtcacgaccggtgctcgatttagtagcatactgttgggtctgggacagacttcactctcaccatcagcagactggagcctgaggattttgcactatatatctgtcagtactatgataattcaccaatgtacacttttggtcaggggaccaagctggagatctaccgaatgtggctgcaccatctgtcttcatcttcccgcatcngaacatctgtactgagcgggctggcaaggcgacatagnnnnnnnnnnnn

SEQ ID NO: 102208 - DNA, 503 bp, Homo sapiens
  misc_feature: GYAE6OF01AF7M0.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagatttgcagtttattattgtcagcagcgaaacaactggcctccttggacgttcggaccaagggaccaaggtggaaatcaaaacgaactgtaggctgcaccatctgtcttcattcc

SEQ ID NO: 102209 - DNA, 496 bp, Homo sapiens
  misc_feature: GYAE6OF01EEIGN.51.83.H06.1.454.CMB.1.raw
  modified_base (198)..(198): a, c, t, g, unknown or other
  misc_feature (198)..(198): n is a, c, g, or t
  modified_base (493)..(493): a, c, t, g, unknown or other
  misc_feature (493)..(493): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaaanagccaccctctcctgcagggccagtcagagtgttagcagcgacttagcctggtaccagcagaaacctggccaggctccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactgtccttcgtactactttcggccgtagggaccaagcgtggagatcaaacgtaactgtggctagcaccntcg

SEQ ID NO: 102210 - DNA, 510 bp, Homo sapiens
  misc_feature: GYAE6OF01DUCLY.51.83.H06.1.454.CMB.1.raw
  modified_base (199)..(199): a, c, t, g, unknown or other
  misc_feature (199)..(199): n is a, c, g, or t
  modified_base (505)..(505): a, c, t, g, unknown or other
  misc_feature (505)..(505): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagtattttgctagttttattattgtcagtcagcgaaacaactggcccttccgttggacgttcggaccagggaccaaggtgaaatcaaacgactgtggctagcacctatactgtcttcntcccg

SEQ ID NO: 102211 - DNA, 491 bp, Homo sapiens
  misc_feature: GYAE6OF01A8VXH.51.83.H06.1.454.CMB.1.raw
  modified_base (296)..(296): a, c, t, g, unknown or other
  misc_feature (296)..(296): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagcgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtncatccaccagggccactggcatcccagccaggttcagtgcagtgggtctgggacagacttcgctctcaccatcagcagcctagagcctgaagattttgctagtttattattgtcagcagcgaacactggcctctgacgttcgcaggacaggtagaancgaaacgactgnggcngcacgtanctagtcttcntccg

SEQ ID NO: 102212 - DNA, 509 bp, Homo sapiens
  misc_feature: GYAE6OF01AWY9T.51.83.H06.1.454.CMB.1.raw
  modified_base (198)..(198): a, c, t, g, unknown or other
  misc_feature (198)..(198): n is a, c, g, or t
  modified_base (344)..(344): a, c, t, g, unknown or other
  misc_feature (344)..(344): n is a, c, g, or t
  modified_base (506)..(506): a, c, t, g, unknown or other
  misc_feature (506)..(506): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtattaacagcgacttagcctggtaccagcagaaacctggccaggctcccaggctcctcatctatggtgcatccaccagggccactggcatcccagccaggttcagtggcagtggtcngggacagacttcgctctcaccatcagcagcctagacgcctagaagtattttgctagtttattattgtcagcagacgaacaactggtcctcgttcggacgtttcggccgagggaccgaaggtaggaaatacgaaacgactgacggctgcactatctgtctcgntcc

SEQ ID NO: 102213 - DNA, 515 bp, Homo sapiens
  misc_feature: GYAE6OF01ANMEJ.51.83.H06.1.454.CMB.1.raw
  modified_base (199)..(199): a, c, t, g, unknown or other
  misc_feature (199)..(199): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaacctggccaggctcccaggctcctcatctatggtgcatccaccagggccactggcatcccagccaggttcagtggcagtgggtctgggacagacttcgctctcaccatcagcagcctagacgcctagaagtatttgctagtttatttattgtcagcagacgaaacaactcggacctccgttggacgttcggaccgaacgggaccgaagggtgaaatacgaaacgactggtaggctgcacactctntcttnctcc

SEQ ID NO: 102214 - DNA, 551 bp, Homo sapiens
  misc_feature: GYAE6OF01DDZSJ.51.83.H06.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagcccaccctctcctgcagggccagtcagagtattaacagcgacttagcctggtaccagcagaaacctggccaggctcccaggctcctcatctatggtncatccaccagggcccatggcactcccagccaggttcagtggcaggtgggtctgggacagacttcgctctcacaatcagcagcctagacgcctagaagtattttgcttagtttatttagttgtcagtacagacgaaacaacgtcggtacccttccgttggaccggttcggacccgaacggggaaccgtaaggtaggaaactacgaaaacgtaacgtggtacggctacggcaccgtatctgtcttctacttcccg

SEQ ID NO: 102215 - DNA, 509 bp, Homo sapiens
  misc_feature: GYAE6OF01C5746.51.83.H06.1.454.CMB.1.raw
  modified_base (505)..(506): a, c, t, g, unknown or other
  misc_feature (505)..(506): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatccccagccaggttcagtggcagtgggtctgggacagacttcgctctcaccatcagcagcctagacgcctgaagtattttgctagtttattattgtcagcagcgaaacaactggcctccgttggacgttcggaccgagggaccaaggtaggaaatacgaaacgaactgtggctgcaccatctgtctnntcc

SEQ ID NO: 102216 - DNA, 536 bp, Homo sapiens
  misc_feature: GYAE6OF01BKCQ0.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatccaccagggccactggcatcccagccaggttcagtggcaggtgggtctgggacagacttcgctctaaccatcagcagcctagagcctgaagtattttgctagtttattattgtcagcagacgaaacaacgtcggccttccgttcgggtaccgtttcggaccgaacggggaccaagggtaggaaataccgaaacgaacgtgtaggctcgacaccatctcgtctttcattccttcccg

SEQ ID NO: 102217 - DNA, 497 bp, Homo sapiens
  misc_feature: GYAE6OF01ARPTG.51.83.H06.1.454.CMB.1.raw
  modified_base (199)..(199): a, c, t, g, unknown or other
  misc_feature (199)..(199): n is a, c, g, or t
  modified_base (491)..(491): a, c, t, g, unknown or other
  misc_feature (491)..(491): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaacctggccaggctcccaggctcctcatctatgatgcatccacaagggccactgatatcccagccaggttcagtggcaggtgggtctgggacagagttcactctcaccatcagcagcctgcagtctgaagtatttgctaatttattactgtcagcagtataatactgtcctcgtactactttggccgtagggaccagctggagtatacgaaacgacgtgtcggctcgacacntcgtcg

SEQ ID NO: 102218 - DNA, 567 bp, Homo sapiens
  misc_feature: GYAE6OF01DATLP.51.83.H06.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacngcgacttagcctggtaccagcagaacctggccaggctcccaggctcctnatctatggtncatccaccagggccactggcatcccagcctaggttcagtggcagtgggtctgggacagacttcgcttctcaccatcgagcacgcctagagcctagaagtatttgctagtttattattgtcagtcagacaaacgtactcggcccttacgttgggaccgtttcggaccgaacggggacctaagggtacggtaaaacgtaccgaaaaacggtaacgtaggttacggcgttacgaccgtaaccgtagtttactacgttccttcgtactttccccg

SEQ ID NO: 102219 - DNA, 531 bp, Homo sapiens
  misc_feature: GYAE6OF01CW4IR.51.83.H06.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (298)..(298): a, c, t, g, unknown or other
  misc_feature (298)..(298): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangcccaccctntcctgcagggccagtcagagtattaacngcgacttagcctggtaccagcagaaacctggccaggctccaggctcctcatctagtggtncatccaccgagggccactggcactcccagcctaggtcagtggcaggtgggtctgggacagtcttcgctctcacatcagcagcctagacgcctagtaagtatttgactagtttattattgtcagcagacaacacgtgtcctcgtggtacgtcggacgaggaccaaggtacgaaactacgaaacggtacgtggtacgcgtacgaccacgtacttactagttcttctcgttacccg

SEQ ID NO: 102220 - DNA, 546 bp, Homo sapiens
  misc_feature: GYAE6OF01BONXK.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatccaccgagggccacgtggcactcccagccaggttcagtggcaggtgggtctgggacagacttcgctctcaccatcagcagcctagacgtcctagaagtatttgctagtttattattgtcagcagacgaaacacgtcggtcctccgttggaccgttcggaccgaacgggaccgaagggtacggaaacgtacgaaaccggtaacgtggtacggtcgtcgacacctattcctagttcttcgacttcccg

SEQ ID NO: 102221 - DNA, 553 bp, Homo sapiens
  misc_feature: GYAE6OF01CY9WB.51.83.H06.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggcctcccaggctcctcatctatggtncactccaccagggcccacgtggcactccccagccgtaggttcaggtggcaggtgggtctgggacagacttcgctctcaccatcagcacgcctagacgcctagaagtattttgacttagtttattattgtcagacagaccaaacacgtcggcccttcgttggaccgttcggaccgaacgggacctaagggtacggaaataccgaaaacgtaacgtggtacggctagaccacctactacttgttcctctacgttccc

SEQ ID NO: 102222 - DNA, 761 bp, Homo sapiens
  misc_feature: GYAE6OF01B772Y.51.83.H06.1.454.CMB.1.raw
  modified_base (387)..(387): a, c, t, g, unknown or other
  misc_feature (387)..(387): n is a, c, g, or t
tcagcgatcgtatacacgaccggtgctcgatttagatcacgtgcgtcgggcgggggaaggaactgctctaggttacggacccaggaacgggaaccagtaggaaccgccccagcctcagtccttccttccttcccttcctgccttacctcgtcggcctcccagacttcggaccgaaccggtactaaagtttggtacgttacgacactacgtctccacgtctacccttgttctttcgtcggtaccgaaggggaacaccgtccctacccttctcctagggccaaggggcccaaggtacgaggtaagtacttaacgacgtacgtacttacgccgtacggtaaccagacctaggaacctggccacggcctccacgcctctcatctatcggtnccactccgaccgacgggccacgtcggccaacgtccccgaggtccagggttcgaggtcggcgtagggtgggtacgtaggggaactacgtaccttcgcctacctacaccatccgagcctagaccctaagacgtacttaggtaacgttacgtttagtaccgttagttttacttacgttacgtacgacgtacgtaacggtaaccgttaaccggtaccgttaccggggtaccccttaacgggttacgggtaaccgtttacggggaaccctaaacggggtaaccgtaagggtacgaaacgtaccgtaaaaccggtcgttacggtcggtacttaccggtacctaccgttacttcccgttacgttccttcctacgttacccg

SEQ ID NO: 102223 - DNA, 550 bp, Homo sapiens
  misc_feature: GYAE6OF01EUXWW.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtattaacagcgacttagcctggtaccagcagaaacctggccaggctcccaggctcctcatctatgatgcatccacaagggccactgatatcccagccaggttcagtggcaggtgggtctgggacaggtagttcactctcaccatcagcagcctgctagtctagtaagtattttgactaattttacttactgtcagctagtataatacgtcgtaccttaccgtacttacgtttcggaccgtaaggggtaacccaaggtctagggtaacgtaagtaccgtaaaacgaccgtggtacgggactcggaccctaccctagtccttacg

SEQ ID NO: 102224 - DNA, 501 bp, Homo sapiens
  misc_feature: GYAE6OF01DRJYB.51.83.H06.1.454.CMB.1.raw
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (497)..(498): a, c, t, g, unknown or other
  misc_feature (497)..(498): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaaagagccaccctctcctgcagggccagtcagagtattaacagcgacttagcctggtaccagcagaaacctggccaggctccaggctcctcatctatggtgcatccaccagggccactggcatcccagccaggttcagtgcagtggtctgggacagacttcgctctcaccatcagcagcctagagcctgaagtattttgactagtttattattgtcagcagacgaacaacgtggcctcgttggaccgttcggacaacgggacaaggtgaaatcgaaacgactgnggcngcacgtatctgtctnntcc

SEQ ID NO: 102225 - DNA, 585 bp, Homo sapiens
  misc_feature: GYAE6OF01BTKVR.51.83.H06.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctnatctatggtncatcccaccgagggccacgtggcatccccagcccaggttcaggtggcaggtgggtcngggacagcttcgctctcaccatcagcagcctagacgcctagaagtattttgacttagtttattattgtcagcaagaccgaaacacgtcgggcccttccgttagggtaccgtttccgggaccgtaacggggacccgtaaagggtacggaaaactaccgaaaacggtaacgttggtacggccttacggacccaaccgtacttaccgttacgttcctttccgacgtttcccccg

SEQ ID NO: 102226 - DNA, 517 bp, Homo sapiens
  misc_feature: GYAE6OF01CNATL.51.83.H06.1.454.CMB.1.raw
  modified_base (197)..(197): a, c, t, g, unknown or other
  misc_feature (197)..(197): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (511)..(511): a, c, t, g, unknown or other
  misc_feature (511)..(511): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaangccaccctctcctgcagggccagtcagagtattaacagcgacttagcctggtaccagcagaaacctggccaggctcccaggctcctcatctatggtgcatccaccagggccactggcatcccagccaggtcagtggcagtntcggggggggggtnacgagacttcgctctcaccatcagcagcctagacgcctgaagtatttgctagtttattattgtcagcagacgaaacactggcctcgttggacgttcggaccagggaccaagggtagaaatcgaaacgacgtgtacggctcgcactactactgtcttctnttcccg

SEQ ID NO: 102227 - DNA, 537 bp, Homo sapiens
  misc_feature: GYAE6OF01BXP52.51.83.H06.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (402)..(402): a, c, t, g, unknown or other
  misc_feature (402)..(402): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccgaggggaaancgccaccctctcctgcagggccagtcagagtattaacagcgacttagcctaggtaccagcaagaaacctggccaggctcccaggctcctcatctatggtncatcccacgagggccatggcatcccagccaggttcagtggcaggtggggtctggggactagtacttcgctctcaccatcagcagcctagacgcctagtaagtnttttgacttagtttattattgtcagcagacgaaactacgtgcccttcgttggaccgttcggaccgaaggacgaaggtagaaactaacgaacgtacgtaggcggctagaccacctattctcgtcttcgacttcccg

SEQ ID NO: 102228 - DNA, 544 bp, Homo sapiens
  misc_feature: GYAE6OF01B7YN0.51.83.H06.1.454.CMB.1.raw
  modified_base (199)..(199): a, c, t, g, unknown or other
  misc_feature (199)..(199): n is a, c, g, or t
  modified_base (393)..(393): a, c, t, g, unknown or other
  misc_feature (393)..(393): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaacctggccaggctccaggctcctcatctatggtgcatccaccagggccactggcatcccagccaggttcaggtggcaggtgggtctgggacagacttcgctctcaccatcagcagcctagacgcctgaagtnttttgctagttttattattgtcagctagacgaaacacgtcggccttcgttggaccgttcggaccgaagggaccgaaggtacggaaataccgaaaacggtaacgttaggtacggtcctgacacccgtacttcttagtccttcgtacttcccg

SEQ ID NO: 102229 - DNA, 538 bp, Homo sapiens
  misc_feature: GYAE6OF01CVFGW.51.83.H06.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (532)..(532): a, c, t, g, unknown or other
  misc_feature (532)..(532): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacngcgacttagcctggtaccagcagaaacctggccaggctccaggctcctnatctatggtncatccaccgagggccactggcatcccagccaggttcagtggcaggtgggtctgggacagacttcgctcgtcaccatcagcacgcctagacgcctagaagtattttgacttagtttattattgtctagcagaccgaaacactcggaccttccgtggtaccgttcggaccgaacgggactaagggtaggaaactacgaaaacggtaactggtaggctcgacaccgtactactgtccttncttccc

SEQ ID NO: 102230 - DNA, 535 bp, Homo sapiens
  misc_feature: GYAE6OF01DVNCD.51.83.H06.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctntcctgcagggccagtcagagtataacngcgacttagcctggtaccagcagaaacctggccaggctcccaggctcctcatctatggtgcatccaccagggccacgtggcactcccagccaggttcaggtggcagtgggtctgggacagacttcgctctcaccatcagcagcctagagcctgaagtatttgctagtttattattgtaagcagacgaaacacgtggtcctcgttcggtacgttcggaccgaagggaccgaagggtacggaaataccgaaacgtaacgtggtaggctcgacacctacgtctacgtctttcattccgtcccg

SEQ ID NO: 102231 - DNA, 540 bp, Homo sapiens
  misc_feature: GYAE6OF01EKHO4.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagacgacccgaagtattttgctagttttattattgtcagcagacgaaacacgtggacctccgttgggtaccgttcggaccgaagggaccaagggtaggaaactacgaaacgaacgtggtaggactgaccaccacttctcgttacttctatcccttaccccg

SEQ ID NO: 102232 - DNA, 544 bp, Homo sapiens
  misc_feature: GYAE6OF01CEL9N.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtataacagcgacttagcctggtaccagcagaaacctggccaggctcccaggctcctcatctatggtgcatccaccagggccactggcactcccagccaggttcagtggcagtgggtctgggacaggacttcgctctcaccatcagcagcctagagcctgaagtatttgctagtttattagttgtcagcagacgaaacacgtgtacccttccgttggaccgttcggaccgtaagggaaccgaagggtaggaaactacgaaaaccggtaacgtagtacggcctaggaccaccattacgtagttcttacgtcttcccg

SEQ ID NO: 102233 - DNA, 550 bp, Homo sapiens
  misc_feature: GYAE6OF01C3BOJ.51.83.H06.1.454.CMB.1.raw
  modified_base (239)..(239): a, c, t, g, unknown or other
  misc_feature (239)..(239): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagacgccaccctctcctgcagggccagtcagagtattaacngcgacttagcctggtaccagcagaaacctggccaggcctcccaggctcctcatctatggtgcactccaccgagggcccacgtggacactccccagccaggttcaggtggctaggtgggtctgggacaggtacttcgctctccacatcagcacgcctagacgcctagaagttatttgcttagtttattattgtacagcagacaacactggccttcgttaggtaccgttcggaccgaacggaccgaaggtacggaaactacgaaacgtaacgtggtacggctacgaccacgtactctagttctcgtcttcccg

SEQ ID NO: 102234 - DNA, 601 bp, Homo sapiens
  misc_feature: GYAE6OF01DGIEZ.51.83.H06.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccgaggggaaagngccaccctntcctgcagggccagtcagagtataacngcgacttagcctggtaccagcagaaacctggccaggctcccaggctcctcatctatggtgcatccaccgagggcctactggcactcccagccaggttcaggtggcaggtgggtctggggacaggacttcgctctcaccatccagcctagccctagagcctagaagtatttgactaagtttattattgtacagctaagacgaaactacgtacggcccttaccgttggaccgtttcggacccgtaaagggaacccgtaaaggggtacggaaaaacgtaccgtaaaaaccggtaaaccgttgggtacggtacgttacgacccgtaaccgtaacgtccttaacggtttcctttacctaactttcccccg

SEQ ID NO: 102235 - DNA, 806 bp, Homo sapiens
  misc_feature: GYAE6OF01CPNE0.51.83.H06.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgctccgaggggaaancgcccaccctctcctgcagggccagtcagagtataacngcgtacttagcctggtaccagcaagaacctggaccaggcctcccaggcctcctcatctagtggtcacactcccgaaccgacggggccctaacgtcgggaccctaaccgtcccccgaacggccccgtaagggtttccgaacgggttcgggaccgtaaggggttcggggggttaccgttggggggaaacctacgggtaacccgttttccggaccttaccttaacccgaaccccgtaagttcccgaacggtaccgaacggtacccgttaagggaaccggtacccgttaaggtaaacggtttaacgtttttcggaacgttttaacgtttttaacgtttaagtttccggtaactaacggtaccgtaacggtaaacccgtaaaacgttaacccggttcgggtacccccgtttaccgggtttacggggtaacccgggtttacccgggaacccggtaacggggtaaacccgtaaaggggtaacggtaaaacgttaccgaaaacgggtaccgtagggtaccggtacgtaccgaccgtaaccctacgttcttaggttacccttacgttaccttccccg

SEQ ID NO: 102236 - DNA, 778 bp, Homo sapiens
  misc_feature: GYAE6OF01B5DB0.51.83.H06.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctacctcatctatggtncatccaccngggccactggcactccccaagccgtaaggttcaggtggaccgaggtcggggtctaggggacaggtaccgttcgccttccgtacaaccattccgacggccaacggtccctaaggaccggtacccttaggtaaacgttatttttacggacttaacgggttttttaacttaagttttcggtaccctaaggtcctaaacgggtaacccggttaaaaaccctaaccggtttacgggtacccccgttttacccgggtttaacggggttaacccgggttttaccccggggaacccggtaaaaccgggggggtaaaccctaaaacggggggttttacgggaaaaaaacccgttaacccgggtaaaaacccgggtaaaacgtttcgggggttaacgggacccgttttacgggaaccccgtaaacccgtaacgtttcccgtttaaggttccccttttaaccgtaacgttttaccccccccgg

SEQ ID NO: 102237 - DNA, 567 bp, Homo sapiens
  misc_feature: GYAE6OF01ERELR.51.83.H06.1.454.CMB.1.raw
  modified_base (198)..(198): a, c, t, g, unknown or other
  misc_feature (198)..(198): n is a, c, g, or t
  modified_base (422)..(422): a, c, t, g, unknown or other
  misc_feature (422)..(422): n is a, c, g, or t
  modified_base (557)..(557): a, c, t, g, unknown or other
  misc_feature (557)..(557): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcaggggaaangccaccctctcctgcagggccagtcagagtattaacagcgacttagcctggtaccagcagaaacctggccaggctcccaggcctcctcatctatggtgcatcccaccgacgggccacgtggcactccccagccaggttcagtggcaggtgggtctgggacagacttcgctctcacatcagcagccctagacgcctagaagtattttcgacttaagttttaattntttgtctagtcgaagacgtaaacacgtccgccttcgtacgtacggttcggacgtaacgggaccgaagggtacgaaacgtaccgtaaacggtacgtggtacgggctcggacctaccgtacttccttagtccttacncgttaccccg

SEQ ID NO: 102238 - DNA, 570 bp, Homo sapiens
  misc_feature: GYAE6OF01D8R6A.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtctccagtcaccctgtctttgctcgaggggaaancgccacctctcctgcagggccagtcagagtataacagcgacttagcctggtaccagcagaaacctggccaggctccaggctcctcatctatggtgcatcccacgacgggccacgtggccactccccagccgtaggttcaggtcggctagggtcgggtcgtgggacaggtaccttcgctctcacatcagcagcctagacgtcctagtaagtatttgacttagtttatattgtcagcaagaccgaaactacgtcggtaccttcggttacggtaccgttacggaccgaacgggaccgtaagggtacgaaaactacggaaacgtacgtggacggtctacgacccaacgtacgtcttagtccttgaccgttccccg

SEQ ID NO: 102239 - DNA, 903 bp, Homo sapiens
  misc_feature: GYAE6OF01DCHZQ.51.83.H06.1.454.CMB.1.raw
  modified_base (240)..(240): a, c, t, g, unknown or other
  misc_feature (240)..(240): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgcccaccggacaaattgtgttgacacagtctccagtcaccctgtctttgtctccgaggggaaagacgcccaccctctcctgcgagggccagtcagagtataacngcgacttagcctggtaccagcagaaacctggccaggctcccgaggctcctcatctatggtgcatccgaccgagggccacgtggacactcccagccgtaggttcaggtcggcgtaaggttcggggtcgttaggggaaccgtaacggtacccgtttccgggtccttaccgttaccctaaccccgtaagttacccgaacggtacccgtaaccgggtccccgttaaacgggtaaccggttaacccgtaacgggtttaaaaggtttaaccggttttttacgggtaacccgttttaaagtttttttaaacgtttttaacgttttacgggtttaaccctaaacgggtacccgtaaacgggtaacccgggtaaaaaaccgttaaccggtttaccggggttaccccccgtttttacccggggttttaacgggggttaaccccgggtttaaccccgggggtaaccccgggtaaaaccggggggtaaaccccggttaaaaacgggggttacgggtaaaaaaacccgtttaaacccggaaaaaaccggggtttaaaacccgttagggggttaaccggggttaacccttacgggtaaaccccgttaaacccgtaaccgttttacccggttacgggttttaacccctttaccgggttaacccgtttttacccccggg

SEQ ID NO: 102240 - DNA, 571 bp, Homo sapiens
  misc_feature: GYAE6OF01CSN2T.51.83.H06.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
  modified_base (565)..(565): a, c, t, g, unknown or other
  misc_feature (565)..(565): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanagccaccctctcctgcagggccagtcagagtataacngcgacttagcctggtaccagcagaaacctggccaggcctcccaggcctcctcatctatggtncactccaccgagggcccacgtcggccactccccgagcccgtaggttccaggtcggcgtagggttcggggtcgtggggaactaggtacctttcgccttctaccacctatccagccacgtcctaagacgacctagaagttagttttgacttagttttattattgtacagcagacgaaacacgtcggtcctcgttggacgttcggaccgagggaccgaaggtagaaactacgaaacgtactggtaggctcgacaccgtatctgttcttncttccg

SEQ ID NO: 102241 - DNA, 525 bp, Homo sapiens
  misc_feature: GYAE6OF01C911V.51.83.H06.1.454.CMB.1.raw
  modified_base (198)..(198): a, c, t, g, unknown or other
  misc_feature (198)..(198): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaaangccaccctctcctgaaggccagtcagagtattaacagcgacttagcctggtaccagcaagaacctggccaggcctcccaggctcctcatctatggtgcatccacaggccactggcatcccagccaggttcagtggcaggtgggtctgggacagacttcgctctcaccatcagcagcctagacgcctgaagtattttgactagtttattattgtcagcagacgaaacacgtcgccttccgttggtacgttcggaccgaacgggaccaagggtacgaaactcgaaacgaacgtgtaggctgacacattctnttcttcnttccttacccg

SEQ ID NO: 102242 - DNA, 516 bp, Homo sapiens
  misc_feature: GYAE6OF01EZ0U9.51.83.H06.1.454.CMB.1.raw
  modified_base (199)..(199): a, c, t, g, unknown or other
  misc_feature (199)..(199): n is a, c, g, or t
  modified_base (489)..(489): a, c, t, g, unknown or other
  misc_feature (489)..(489): n is a, c, g, or t
  modified_base (509)..(510): a, c, t, g, unknown or other
  misc_feature (509)..(510): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctccaggctcctcatctatggtgcatccaccaggggcccactggcatcccagccaggttcagtgcaggtgggtctgggacagacttcgctctcaccatcagcagcctagacgcctagaaagtattttgacttagttttattatttgtcagcagacgaaacaacgtggcctcgttggacgttcgaccaagggaccaaggtagaaatacgaaagactgnggctgcacctatctatcttnnttcccg

SEQ ID NO: 102243 - DNA, 693 bp, Homo sapiens
  misc_feature: GYAE6OF01AK502.51.83.H06.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgaggggaaancgccaccctctcctgcagggccagtcagagtataacagcgacttagcctggtaccagcagaacctggccaggcctcccaggcctcctcatctatggtncactcccacgacgggccacgtggccacgtccccagcccgtaggttcaggtcggctagggttcgggtcgtaggggaccaggtaccttcggcctccgtccacctagtccaagccgacgcccgttaaggaccgtcccgttaggtaaagttactttttacggactttaagtttttatttaacgtttcggttacaggtaccgaaggtaacccgaaaactacccggttacggtccccgtttacccggttacgggtaccggtttaccgggaacccggaaacggggaaccgtaaaggggtaacggtaaaacgtaaccgaaaaccgggtacgttagggtacggtaccgtacgacccgtaaccgttacgttccgtaggtttcccttacgtaccgtttacccccg

SEQ ID NO: 102244 - DNA, 567 bp, Homo sapiens
  misc_feature: GYAE6OF01CNF19.51.83.H06.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccaggggaaanagccaccctctcctgcagggccagtcagagtattaacngcgacttagcctggtaccagcaagaacctggccaggctcccaggctccncatctatggtncatccaccagggccactggcacgtcccagccaggttcaggtggcaggtgggctgggacaggacttcgctctcacatcagcagcctagacgtcctagaaagtattttgactaagttttattagttgtcagtcaagaccgaaaactacgtcggtcccttccgttaggtaccgtttcggaccgaaggggaaccgtaagggtaggtaaaactacgaaaacggtactaggtacggtctacggccaaccgtactacgttgttcttcacgtttccccg

SEQ ID NO: 102245 - DNA, 568 bp, Homo sapiens
  misc_feature: GYAE6OF01A3T92.51.83.H06.1.454.CMB.1.raw
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (563)..(563): a, c, t, g, unknown or other
  misc_feature (563)..(563): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaancgcccaccctctcctgcagggccagtcagagtataacagcgacttagcctggtaccagcaagaaacctggccaggcctcccgaggcctcctcatctagtggtncactccaccgagggccacgtcggcactccccagccaggttccaggtcggcaggtgggtctgggacagtacttcgcctctcacntcagcacgcctagcgcctagaagtatttgacttagtttattattgtacagcaagaccgaaactaccgtcggtacccttccgttacggtaccgttcggaccgtaacgggaccaagggtacggaaactacgaaacgtacgtggtacggctacgaccaaccgtactcttagttcttcgtnttccg

SEQ ID NO: 102246 - DNA, 508 bp, Homo sapiens
  misc_feature: GYAE6OF01CFDLR.51.83.H06.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (419)..(419): a, c, t, g, unknown or other
  misc_feature (419)..(419): n is a, c, g, or t
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagccaccctgtctttgctccaggggaaangccaccctntcctgcagggccagtgagagtattgacatcttcttggcctggtaccaacagaaacctggccaggctccccgactcctcactttatgatgcatccaaaagggtcttggcatcccagccaggttcagtggcagtggtctgggacagaatcgactctcacatcacagactagagcctagaagtattttgctagtttattactgtcagcagctaanactggctctcgttcggcggacggaccaaggtggagatacgaaagactgttggcttcgcactntctgtcttcattcctcccgctnttacg

SEQ ID NO: 102247 - DNA, 534 bp, Homo sapiens
  misc_feature: GYAE6OF01D31TI.51.83.H06.1.454.CMB.1.raw
  modified_base (198)..(198): a, c, t, g, unknown or other
  misc_feature (198)..(198): n is a, c, g, or t
  modified_base (529)..(529): a, c, t, g, unknown or other
  misc_feature (529)..(529): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtataacagcgacttagcctggtaccagcagaacctggccaggctcccagctcctcatctatggtgcatccacgaggccacgtgcactcccgagccaggttcaggtggctaggtgggtctggggacaggtacttcgcttctacaccatcagcacgcctagacgcctagaagtatttgacttagttttattattgtacagctaacgacgaaactaacgtcgtcctccgttggtaccgttcggaccgaagggaccgaaggtagaaacgtacgaaacgtactgaggctacgacactatctagtctnctccc

SEQ ID NO: 102248 - DNA, 666 bp, Homo sapiens
  misc_feature: GYAE6OF01EPI0Q.51.83.H06.1.454.CMB.1.raw
  modified_base (199)..(199): a, c, t, g, unknown or other
  misc_feature (199)..(199): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtataacagcgacttagcctggtaccagcaagaaaccctggccaggcctcccgaggcctcctcatctatggtncactccgaccgngggcccacgtggaccactccccgagtccgtaggttcaggtcggacgtagggtcggtccgtagggactacgtaccgtcgtacctcgtaccaactactcacggacctacggtacctacggtacgtaccgttaaggtaagttacgttttcgtaacgtttaagtttttattacgttcgtacgacggtaactaacggaaccgtaaactccggttaccggtacccgtttacgggttaaccgggtaccggttaaccggaacccggaaacgggtaaccggtaaaggtaaaggtaaaccgtaacgaaacgtacgttggacgctacgtacctaactcgttactcgttactacgtccttacccg

SEQ ID NO: 102249 - DNA, 552 bp, Homo sapiens
  misc_feature: GYAE6OF01B9A5W.51.83.H06.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagngccaccctctcctgcagggccagtcagagtattaacagcgacttagcctggtaccagcagaacctggccaggctcccaggcctcctcatctatggtncatcccaccagggccactggcatcccagccaggttcagtggcaggtgggtctgggacagacttcgctctcacatcagcagcctagacgcctagaagtattttgactagttttatagttgtcagcagacgaaactacgtcggcccttccgttaggaccgttcggacccgtaaggggacccgtaagggtacggaaaactacgaaaacggtacgtggtcggtctcgaccaccgtacttctagttcttccgattccccg

SEQ ID NO: 102250 - DNA, 749 bp, Homo sapiens
  misc_feature: GYAE6OF01CTID1.51.83.H06.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatgccaccggacaaattgtgttgacacagtctccagtcaccctgtctttgctccgagggaanacgccacctctccgtgcaggccagtcagagtattaacngcgtacttagcctggtaccagcaagaaacctggaccaggctcccgaggcctcctcactctatggtcgcactccgaaccgacgggccacgtcggacctaacgtccccgaagcccgtaaggttcgagggtcggacgtaggggttcgggtcgtacggggaactacggtacgttcgccttctaccgaacctagtccgaacgtccgaagtacccgttaaggaccgtaccgttaagtaaacgtttacgttttacggactttaaggtttttaactttacggtttagtaccgtaagaccgtaacggaaaccgtaaaacgtaccggttacgggtacccctttaccgggttacgggtaacccggttaccgggaacccggaaaggggtaaccccgtaaaggggttaaccggaaaaccgttacggtaaaaacccggtaacgttacggggttaccggtaccgttaccggacccttaaccgtacggtttccgttaaccgtttaccttacccgtacgtttaccccccgg

SEQ ID NO: 102251 - DNA, 532 bp, Homo sapiens
  misc_feature: GYAE6OF01BHJMG.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcaggtgggtctgggacagacttcgctctcaccatcagcagcctagacgcctgaagtattttgctagttttattattgtcagcagacgaaacactggcctccgttggacgttccggaccgaacgggaccgaagggtcggaaataccgaaacgaacgtggtacggcgtacgcacctatctagtccttcgtcttcccg

SEQ ID NO: 102252 - DNA, 619 bp, Homo sapiens
  misc_feature: GYAE6OF01CHRUR.51.83.H06.1.454.CMB.1.raw
  modified_base (373)..(373): a, c, t, g, unknown or other
  misc_feature (373)..(373): n is a, c, g, or t
tcagcgatcgtatacacgaccggtgctcgatttagatcacgtgcgtcggcgggggaggaactgctcagttaggacccagacgggaaccatggaagtccccagctcagcttctcttcctcctgctactctggctcccagatgccaccggacaaacttgtgttgacacagtctccagtcacccgtgtcttgtcctaccaggggaagagccaccctctcctgcagggccagttcagagtattaacagcgactagcctggtaccagcagaaacctggaccaggcctcccaggcctacctcatctatggtcgcactccaccgacgggcccacgtcggccactcccagccaggttcagtggcgtaggtgggctgggacngaccttcgctctcaccatccagcacgcctagacgtcctagtaacgttagtttacgtacgtttaagttttatttagttcgtactagtctaaggtaccgtaaactaccgttcggtccccgttccgttacgggtaccggtttccgggacccggtaacgggaacccgtaagggtacggaaactacgaaaccggtaacgtaggtacggctacgacctaccgtacttacctgttaccttcgtacgttccccg

SEQ ID NO: 102253 - DNA, 568 bp, Homo sapiens
  misc_feature: GYAE6OF01D5P2O.51.83.H06.1.454.CMB.1.raw
  modified_base (200)..(200): a, c, t, g, unknown or other
  misc_feature (200)..(200): n is a, c, g, or t
  modified_base (545)..(545): a, c, t, g, unknown or other
  misc_feature (545)..(545): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangccaccctctcctgcagggccagtcagagtattaacagcgacttagcctggtaccagcagaaacctggccaggcctcccaggcctcctcatctagtggtgcatccgaccgagggccacgtggcactcccagcctaggttcaggtcggcaggtggggtctggggacaggtaccttcgctcgtcaccatcagcacgcctagacgtcctaggaagtattttgacttagttttaattagtgtacagcaagtaccgaaactagtccggccttccgttaggtaccgttcggaccgaagggtaccaagggtacgtaaacgtacgaaacgtacgtggcggctacgacaccgtnttcgtattcttcgtacgttcccg

SEQ ID NO: 102254 - DNA, 563 bp, Homo sapiens
  misc_feature: GYAE6OF01A1WFP.51.83.H06.1.454.CMB.1.raw
  modified_base (199)..(199): a, c, t, g, unknown or other
  misc_feature (199)..(199): n is a, c, g, or t
  modified_base (372)..(372): a, c, t, g, unknown or other
  misc_feature (372)..(372): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctcctcatctatggtgcatccaccagggccactggcatcccagccaggttcaggtggcaggtgggtctggggacagacttcgctcgtcaccntcagcagcctagacgtcctagtaagtattttgacttagttttattattgtcagtcagacgaactaacgtacggccctccgttggaccgttcggaccgtaacgggaccgtaagggtacggaaactacgaaaacggtaacgtaggtaggtctacggaccaacctacttacgttacttaccttctacgttcccg

SEQ ID NO: 102255 - DNA, 718 bp, Homo sapiens
  misc_feature: GYAE6OF01A201B.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagacgccaccctctcctgcacgggccagtcagagtataacagcgacttagcctggtaccagcaacgaaaccgtggccaggcctcccgacggtcctcctactactcgtagtggtcgacactcccgaccgacgggccctacgtcggacctactaccccgacgtcccgtaggttccgaggtcggacgtagggtcggggtcgtaggggactaggtaccgttcgcctacctaccgaaccgtactacgacgaccgaacgtaccgtaaggacgtacctaggtaaactttagtttcgacgtttaagtttttacttagttcgtacgtacgtacgtacgaaccgtaaaacgtccgttcggtaccccgttacgttaccggggtacccggtttacggaacccggtaacggggtaaccgtaaaggggtaacgtaaaacgtaaccggtaaaacgggtaccggtggtaaccgggtcctacggtacccgaacgttacgttccgttaagtttcccttaaccgtcccgtttacccccg

SEQ ID NO: 102256 - DNA, 797 bp, Homo sapiens
  misc_feature: GYAE6OF01D51HO.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcggcgggggaggaactgctcagttaggacccagagggaaccagtggaacgcccagctcagcttctcttcctcctgctactctggcctcccagatgccaccggacaaatttgtgttgacacagtctccagtcacctgtcttgtctcgagggaagngccacctctcctgcagggccagtcagagtatacagcgacttagcctggtaccagacagaaacctcggaccgacggccttcccgaggcctcctcactcttatggtgacctactcccaaccgacgggcccaacgtcgggacaccgttaccccgacggcctaagggttccaagggttcggacgtacgggttcggggttcgtacgggggtaacctaacggtaccgtttccggcccttaccgttaccgaacctacgttaccgaacggtacccgaacggtcccgttaaaggaccggtacccgttaaggtaaacgtacgttttttaggaccgtttaagttttttactttaagtttcgtactaggtacctaacgggtaaccgtaaaaccgtaaccgttccgggtaccctttacccgggttttacggggtaacccgggttttcccgggaacccggaaacggggtaacccgtaaaaggggttaacgggtaaaaccttaacccggaaaaaccgggttaaaccgtaggggttaccgggtcccgttaacggaccccgtaaacccgtacgtttaccgttaccggtttcctttaccttaccgtttacccccg

SEQ ID NO: 102257 - DNA, 728 bp, Homo sapiens
  misc_feature: GYAE6OF01CKS88.51.83.H06.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggaacaaattgtgttgacacagtctccagtcaccctgtctttgtctccgaaggggaaanacgcccaccctctcctgcgagggccagtcagagtataacgagcgacttagcctaggtaccagcaagaaactggccaggcctccgagctcctnactctagtggtcncaactcccaaccgcgggaccacgtcggacacctccccgagccgtagggttcagggtcggacgtagggtcgggtacgtaggggaacctagtaccttcgcctccgtaccaccctaatccgaacgcgacgtacctagggtaacgaccgttaggtaaacgtttagttttacgtacgtttaagttttaatttacgttacggtacaacgaccgaaggtaaacccgtaaaacgtaccggttccggttcccgttaaccggtttaccggggtaaccggtttaccgggaacccggtaaacgggggtaaacccgtaaaggggttaaccgtaaaaacgttaacccgaaaaaccggttacggttaagggtcggtaccgaccggtaaccaacccgtacttcgtacgtttaccgttacctaaccgtttcccccg

SEQ ID NO: 102258 - DNA, 540 bp, Homo sapiens
  misc_feature: GYAE6OF01D2UGT.51.83.H06.1.454.CMB.1.raw
  modified_base (199)..(199): a, c, t, g, unknown or other
  misc_feature (199)..(199): n is a, c, g, or t
  modified_base (398)..(398): a, c, t, g, unknown or other
  misc_feature (398)..(398): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcaagaaacctggccaggctcccaggctcctcatctatggtgcatccaccgagggccactggcactccccagccaggttcagtggcaggtgggtctgggacagcttcgctctcaccatcagcagcctagacgcctagaagtntttgactagttttattattgtcagcagacgaacactcggaccctccgttggtaccgttcggaccgaagggacccaaaggtacggaaactacgaaacgacgtggtacggcctagccaacctctctagttccttcgacttcccg

SEQ ID NO: 102259 - DNA, 532 bp, Homo sapiens
  misc_feature: GYAE6OF01DYWTU.51.83.H06.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (523)..(523): a, c, t, g, unknown or other
  misc_feature (523)..(523): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacgcagtctccagtcaccctgtctttgtctccaggggaanagccaccctctcctgcagggccagtcagagtattaacagcgacttagcctggtaccagcagaaacctggccaggctcccaggctcctcatctatggtncatccacgacgggccacgtggcatcccagccaggttcagtggcagtgggtctgggacagacttcgctctcaccatcagcagcctagacgcctagaagtattttgctagttttattattgtcagcagacaacaacgtcggtccttcgttggacgttcggaccagggaaccaagggtaggaaactacgaaacgaacgtggtacggtctgaccactactctgttccttcncgttacccg

SEQ ID NO: 102260 - DNA, 522 bp, Homo sapiens
  misc_feature: GYAE6OF01A75OB.51.83.H06.1.454.CMB.1.raw
  modified_base (199)..(199): a, c, t, g, unknown or other
  misc_feature (199)..(199): n is a, c, g, or t
  modified_base (515)..(515): a, c, t, g, unknown or other
  misc_feature (515)..(515): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaagngccaccctctcctgcagggccagtcagagtataacagcgacttagcctggtaccagcagaacctggccaggctcccaggctcctcatctatggtgcactccaccgagggcccacgtggcactcccagccaggttcaggtcggcaggtgggtctgggacagcttcgctctcaccatcagcagcctagagcctgaagtatttgctagtttattattgtcagcagacgaacaactcggcctcgttggacgttcggaccgagggaccaagggtacgaaatacgaaacgtacgtaggtcggctgaccactatctgtcttcncttcccg

SEQ ID NO: 102261 - DNA, 517 bp, Homo sapiens
  misc_feature: GYAE6OF01DOMX4.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagngccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctgcagtctgaagtattttgactaatttattactgttacagtcagtataataactggccttaccgtactactttcggccgtacgggacctaagcgtaggagagtacaaacgacgtagtggactcgacaccatctgttacc

SEQ ID NO: 102262 - DNA, 657 bp, Homo sapiens
  misc_feature: GYAE6OF01CIJW0.51.83.H06.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaancgccaccctctcctgcagggccagtcagagtataacngcgacttagcctggtaccagcaagaaacctggccaggcctcccgaggcctcctcatctagtggtncactccacgagggccactggacactcccagccagggttcaggtggactagggttcggggtctggggaacngtaccgttcgctcgtcaccatcgagcacgtctaacggacgtcctaagtaaacgtttaagttttcgacttaagtttttaattactttcggtactaggacaacggtaaccgtaaaactaaccgtcgggtaccccttaccggttagggtacccggtttaccgggtaaccggaaacggggtacctaaacggggttaagaaaaccgttaccgaaaaacggtcgtagggtacggtaacctaggaccctaaaccgtcgttaccgttacggttaccttcgtactttaccccgg

SEQ ID NO: 102263 - DNA, 647 bp, Homo sapiens
  misc_feature: GYAE6OF01EQVZ5.51.83.H06.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (408)..(408): a, c, t, g, unknown or other
  misc_feature (408)..(408): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanacgccaccctctcctgcaggccagtcagagtataacagcgacttagcctgaccagcagaaccnggccagctccagctccncatctatggtncactccgacgacgggcccactggcactcccgagcccgaggttcaggttcggctagggtgggtctggggactacggtacttcggcctcgtacaaccgtatccaagccacgcctagacnccgttagaagttatttgacttaagttttacttagttcgttacgagcaacggtaaccgaaaactcgtacgggtcccttaccggttacgggtacccgtttaccgggaccccgtaaaggggtaacccgtaaaggggttaacggtaaaacgttaacccgaaaaccgggttaacgttagggtaccgggtcctacggaaccctaaccgtacttacgttacgtttaccttccgtaacctttccccg

SEQ ID NO: 102264 - DNA, 589 bp, Homo sapiens
  misc_feature: GYAE6OF01DM0KG.51.83.H06.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (577)..(577): a, c, t, g, unknown or other
  misc_feature (577)..(577): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgctccgaggggaaancgcccaccctctcctgcagggccagtcagagtattaacngcgacttagcctggaccagcaagaacctggccaggcctcccgaggcctcctcatctatggtncatcccacgagggccacgtggccactccccagcctaggttcaggtcggcgaggttcgggtcgtaggggacaggtaccttcgccttccgtacacctatccgagcacgcctagacgtcctagtaagtatttgacttagtttattattgtactagctaagacgtaacgtacgtcggccttcgtaggtaccgttcggaccgaagggaccgtaaggtacgaaactaccgaaaacgtaccgtaggtacggcgtacgaccgtacctattccgttattaccttntaccgttccccg

SEQ ID NO: 102265 - DNA, 619 bp, Homo sapiens
  misc_feature: GYAE6OF01E2KMT.51.83.H06.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
tcagcgatcgtatacacgaccggtgctcgatttagatcacgtgcgtcgcgggggaggaactgctcagttaggacccagagggaaccatggaagcccccagctcagcttctcttcctcctgctactctggctcccagatgccaccggacaaattgtgttgacacagtctccagtccaccctgtctttgctccaggggaaangcccaccctctcctgcagggccagtcagagtataacngcacttagcctggtaccagcagaaacctggccaggcctccaggctcctcatctagtggtgcactcccaccgacgggcccacgtggaccactccccgagcccgtacgggttcaggtcggctaggggtcgggtcgtggggacagtaccgtttcgcctctccacctatcgagcacgcctagacgtcctagtaacgttattttgacttagttttattattcgtcacgacacgaccgaaactacgtaccggtccttacccggttagggtacccggtttaccggaccggtaaacgggtaaccgaaagggtacggtaaactaaccgaaaccggtacgttaggtacggtcgtacgcctaacgtacttcttcgttcttccgcgttaccccg

SEQ ID NO: 102266 - DNA, 530 bp, Homo sapiens
  misc_feature: GYAE6OF01EQS0D.51.83.H06.1.454.CMB.1.raw
  modified_base (198)..(198): a, c, t, g, unknown or other
  misc_feature (198)..(198): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (522)..(522): a, c, t, g, unknown or other
  misc_feature (522)..(522): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaaangccaccctctcctgcagggccagtcagagtataacagcgacttagcctggaccagcagaaacctggccaggctccaggctcctcatctatggtgcatccaccgagggccacgtggcactcccagccaggttcagtggcagtgggtctgggacagacttcgctctcaccatcagcacgcctagacncctgaagtntttgctagttttattattgtcagcagacaaacacgtcggcctcgttacggacgttcggaccgaacgggaccgaagggtagaaactacgaaaacgtacgtgtaggtctacgaccacctatcgtattccttntcttcccg

SEQ ID NO: 102267 - DNA, 518 bp, Homo sapiens
  misc_feature: GYAE6OF01ESRV9.51.83.H06.1.454.CMB.1.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (497)..(497): a, c, t, g, unknown or other
  misc_feature (497)..(497): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtataacagcgacttagcctggtaccagcagaacctggccaggctcccaggctcctcatctatggtncatccacagggccacgtggcactcccagcccaggttcaggtggcaggtgggtctgggacaggcttcgctctcacatcagcacgcctagagcctgaagtattttgcttagtttattattgtcagcagacgaaacacgtgcctcgttggacgttcggaccgaagggtaccaaggtagtaaatacgaaacgacgtagtcggctacncactatctgtcttcattcccg

SEQ ID NO: 102268 - DNA, 576 bp, Homo sapiens
  misc_feature: GYAE6OF01A144W.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangccaccctctcctgcagggccagtcagagtattaacagcgacttagcctggtaccagcagaaacctggccaggctcccaggcctcctcatctatggtgcatcccaccgacgggccacgtcggcactcccgagtccgaggttccaggtcggctaggtgggtctgggacagtacttcgctctaccactatcagcagcctagacgcctagaagtatttgactagtttattagtcgtcagtacgagaccgtaaactacgtcggtcccttcggttacggtaccgttccggaccgtaaggggaccctaagggtacgaaactaccgaaacgtacgttggacggtcacggtaccacgtactctagttccttcgtacgttccccg

SEQ ID NO: 102269 - DNA, 718 bp, Homo sapiens
  misc_feature: GYAE6OF01B137V.51.83.H06.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctccagatcgccaccggacaaattgtgttgacacagtctccagtcaccctgtctttgctccgagggaancgccacctctcctgcaggcagtcagagtataacngcgtacttagcctggtaccagcaagaacctggccaggcctcccgaggcctcctacatctagtggtcacctactcccaccgacgggacccacgtcggacctacgtccccgagacccgtagggttaccagggtcggacgagggttcggggtaccgtagggggaacctaggtacccgttcggtccttaccgtaccaaccgtagttaccgacggtaccaacggtaccttaagggacgtacccgttaaggtaaacgtttagtttttacggacttttaaggttttactttaagttccgtacgtaacgccgtaaggtaccgttaagtaccgttaacggttcccggtaccccttacccgtacggtaccttaccccgtacccgttaccgggaaccggtaaacgggaccctaacgggtacggtacgggaaaagtaaaccgtaaaaccgggtacgttggtacggtaccctacggtaaccacctagtttccgttaccg

SEQ ID NO: 102270 - DNA, 525 bp, Homo sapiens
  misc_feature: GYAE6OF01CZMNU.51.83.H06.1.454.CMB.1.raw
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtncatccacagggccatggcatcccagccaggtcagtggcagtgggtctgggacagcttcgctctcaccatcagcagcctagacgcctagaagtattttgactagtttattattgtacagcagacgaaacaacgtcggccttcgttggaccgttcggaccgaacgggaccgaagggtacgaaatacgaaacgactggtacggctgacaccgtatctagtcttctctcccg

SEQ ID NO: 102271 - DNA, 638 bp, Homo sapiens
  misc_feature: GYAE6OF01DJQ11.51.83.H06.1.454.CMB.1.raw
  modified_base (592)..(592): a, c, t, g, unknown or other
  misc_feature (592)..(592): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgaaggggaaagcgcccaccctctcctgcgagggccagtcagagtattaacagcgacttagcctggtaccagcaagaaacctggccaggctcccgaggcctcctcatctagtggtgaccactacccaacccgacggggccccaacgtcgggacccacttccccgaagccccgtaaggttccaggtggacctagggttgggtccgtaggggaccaggtaccttcgctctaccaccgatcgacgcacgcctagacgtcctagaacgtatttgactagttttatattgtacagtacaagaccaaactacgtcgtcccttcgttaggtacccgttcgggaccgaacgggtaaccgtaaagggtaacgtaaaacgtaacgtaaaaccggaccgttaggtacggtccncgggtaaccaccgtactaccgttgtcctttccgtacctttaccccg

SEQ ID NO: 102272 - DNA, 622 bp, Homo sapiens
  misc_feature: GYAE6OF01B1OQ7.51.83.H06.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgctccgaggggaaancgcccaccctctccngcagggccagtcaagagtaataacagcgacttagcctaggtaccagacaacgaaacctggaccaggcctcccgaggtcctcctcatctagtggtgcatcccacgagggcccacgtcggcactcccagccgtaggttcaggtggcagggtgggtctgggacagtaccttcgcttcgtacaaccgtatcgagcacgcctaagacgtacctagaacgttagtttacgacttaagttttattagttacgtacagtacgaagaaccgtaaaacacgttcggtacccttcgttacgggtaccgtttacgggaaccgtaacgggaaccgtaaagggtaacgaaacgtaaccgaaaacggtactagggacggtacgcgaaccaccgtattcgtacttccttactccgttaccccg

SEQ ID NO: 102273 - DNA, 574 bp, Homo sapiens
  misc_feature: GYAE6OF01EBML6.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtataacagcgacttagcctggtaccagcaagaaacctggccaggcctcccaggctcctcatctatggtgcatccacgagggccactggcatcccagccaggttcagtggctaggtgggtctggggacaggtacttcgcctctcaccatcagcacgcctagagcctagaagtattttggacttagttttatttatgtcagcagacgaaacacgtggtccctacgttgggaccgtttacggaccgtaacgggaccgtaaagggtacggtaaaacgtaccaaaacggtaacgttagggtcggtcgttacgaccaaccgtattaccgtagtttccttcgactttaccccg

SEQ ID NO: 102274 - DNA, 542 bp, Homo sapiens
  misc_feature: GYAE6OF01CLTYD.51.83.H06.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (533)..(533): a, c, t, g, unknown or other
  misc_feature (533)..(533): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtataacngcgacttagcctggtaccagcagaaacctggccaggctcccaggctcctnatctatggtgcatccaccagggccacgtggcactcccagccaggttcagtggcaggtggtctgggacagtacttcgctcncaccntcagcagcctagagtcctagaatatttgactagtttattagttgtacagtcagacgaaactacgtcggaccttacgttgggtaccgttcggaccgaacgggaccaagggtacgaaacgtacgaaaacgtacgtgaggtctcggacaacctattctagtccttnacgttcccg

SEQ ID NO: 102275 - DNA, 310 bp, Homo sapiens
  misc_feature: GYAE6OF01AQE7Q.51.83.H06.1.454.CMB.1.raw
  modified_base (305)..(310): a, c, t, g, unknown or other
  misc_feature (305)..(310): n is a, c, g, or t
tcagcgatcgtatacacgaccggtgctcgatttagatcacgtgcgtcgcggggagtctgggcctaaggaagcagcactggtggtgcctcagccatggcctggaccgttctcctcctcggcctcctctctcactgcacaggctcggaggccgactatttctgtcacgtgggagagtagtagtgatcatccgtgctattcggcggagggaccaagctgaccgtctaggtcagcccaaggctcgccccctggtcactctgttcccgccctcctctcgtagcactctgagcggctggcaaggcgcatgnnnnnn

SEQ ID NO: 102276 - DNA, 825 bp, Homo sapiens
  misc_feature: GYAE6OF01B8PBZ.51.83.H06.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (810)..(810): a, c, t, g, unknown or other
  misc_feature (810)..(810): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctaccgaggggaancgccaccctctccgtgcgagggccagtcagagtattaacngcgtacttacgccgtaggtaccagacaacggaaaacctggacccaacggcctacccgacggtcctcctacacttcctaagttcggtacgcctaacgtccccaacccgacggggaccctaacgtcgggacctaacgttcccccgaaggacccgtaagggttttacccgaagggtcgggtaccgttaaacgggggttcgggggttacccggttagggggaacccgtaagggttaacccgtttacccgggtcctttacccggttacccgaaacccctaaacgttacccgtaacggtacccgaacgtacccgtttaacggacccggtaccctaagggttaaagtttacgtttttaaccggtatttaaaggtttttaactttaagttacggttaaacgccggttaaacggaaccgtaaaaacctaccgttcgggtacccctttacgggtaccgggtaacccgtttaccgggaaccctaaaggggaacccgtaaagggtacggaaaaaccttaccggaaaacgtacgtacggtacggaccgttacgacgtaactacgttacgtcgttactttcccgngttccccgttacccg

SEQ ID NO: 102277 - DNA, 775 bp, Homo sapiens
  misc_feature: GYAE6OF01CXO9E.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccgaggggaaagagccaccctctcctgaagggccagtcagagtattaacagcgacttagcctggtaccagacaacgaaacccgtggaccaacggcctcccgtaacggccttccctctaatctaagtgggtgccactcccaaccgacgggcccacgtcggaccacctcccaagcccgtaggttaccgaggtcggacgtaggttacggggtcgtacgggacgtaacggtaccttccggtcctccttacccgaacctacttaccgacgtccaagtaccccggtaaaggactacccgtaaggtaaagtttacgtttttcggaactttaaggttttttacttaacgttttgggtaacccacggtaaccgtaaacgggtaacccgttaaaaaccgtaaccggtttccggttaccctttaacccgggtttgggtaaccccgggtttaccggggaaaccctaaaaggggggtaccctaaaagggggttaccgaaaaaacgtaccggtaaaaaccggtacggtcgggttaacgggcccttaaggacccttaacgtaacttccgttacgttacctttaccgcttttccccgtaccccg

SEQ ID NO: 102278 - DNA, 779 bp, Homo sapiens
  misc_feature: GYAE6OF01B84BO.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagacgccacccgtctcctgcgagggccagtcagagtattaacagcgacttagcctggtaccagacaacgaaacctggaccacggcctcccgaggcctcctcatctagtggtcgacactcccgaccgacgggcccacgtcggccactccccgagtcccgtaggttcgaggtcggacgtacgggttggggtccgtaggggaacctacggtacctttccgccttcgttaccaaccgtacttacgacgacccgacggtacccgtaacggaaccggtcccgttaaggtaaaccgtttacgtttttacgaaccttttaaacgtttttaactttaaccgtttacggttaaccgtaacgtaaccgttaaaggtttaaacttaaaacgttaaccggttaccgggttaccccgtttaacccggttaacccgtttaaccggtttttccggggaacccggttaacggggtaacccgtaacggtaccggtacgggtaacgtaacccgttaaccgtaaaacggttaacgttcgggtaccggtaccgttaccggaaccctaacccgttagttacccgtttccgttcctttaacccg

SEQ ID NO: 102279 - DNA, 744 bp, Homo sapiens
  misc_feature: GYAE6OF01AB6CH.51.83.H06.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcgaggggaancgcccacctctcctgcgagggccagtcagtagtataacngcgtacttacgccgtggtaccagcaacgaaccgtcggaccacggcctcccgaggtcctacctcgtattcctagtcggtcgaccacttccccgaacggtacgggtccctacgtcggacctacctccccgacgtccgtaggttccgaggtcggtcgtagggtgggtcgacgggaccacggttaccgttcgcttcctaccgacctacgtcgacggtctacgaccgtagaccgtcgtaaggtaagtttactttacgtacgtttaagttttactttacgttcgtaaccgtacgtacccggaaagtaaccgttaaaaccgtccggtttaccggtaccccgttttaccggggttaaccggggttaacccggtttacccgggaacccggtaaaacgggggttaaccccgtaaaaggggttacgaaaaacctaacccgggtaaacgttacggtcgggttacggacttaccggacctaaccttcggttctaccggttccttacgtccctttcccccg

SEQ ID NO: 102280 - DNA, 744 bp, Homo sapiens
  misc_feature: GYAE6OF01D1PMJ.51.83.H06.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccacggacaaattgtgttgacacagtctccagtcaccctgttcttgtctcgaggggaaacncgccacctcnctgcgaggccagtcagtagtattaacngccgactacgctggtaccagacagaacctggacagctaccgagctcgtcatctagtcggtcncactccgaacgacgggtccaacgtggactacgtcccgagtccgaggtttcaggtcggctaacgggtgggttaccgtggggaacctacggtaccgttccggaccttaccgtaccaacgtacgtacgacggtaccgtacggtacccgtagaccggttacctaaggtaacgtttaacttttcgggaacctttagtttaacttacggtttacgtacgtaaggtaccgtaaggtaacccggtaaaacgtccggttaccgggtcccctttaccgggtttaacgggtaacccgggtttacccgggaaacccggtaaacgggtaacccggtaaacgggtttaaacggtaaaaccgttaaccggtaaaaaccgggtaccgttagggtaccgggtactaccggtacctaacccgggttacgttcgttaccgttaccgttacgtaccgtttaccccgg

SEQ ID NO: 102281 - DNA, 587 bp, Homo sapiens
  misc_feature: GYAE6OF01AW9ZT.51.83.H06.1.454.CMB.1.raw
  modified_base (200)..(200): a, c, t, g, unknown or other
  misc_feature (200)..(200): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanagccaccctctcctgcagggccagtcagagtattaacagcgacttagcctggtaccagcagaaacctggccaggctcccaggctcctcatctagtggtgcactccgaccgagggcccacgtggcctactccccagcccgtaggttcaggtcggcgaggtggggtcgtgggacagtacgttccgctctcaccatcacgcagcctagacnccgtagaagtntttagcttagtttattgttgtcagtcgagaccgaaacgtacgtcgccgttaccgttagggtaccgttcggaccgaacgggaccgtaagggtacggtaaacgtaccgaaaccggtacgttaggacggtcgtacgaccaccgtagttcgtacgttcttcctacgttcccg

SEQ ID NO: 102282 - DNA, 781 bp, Homo sapiens
  misc_feature: GYAE6OF01A4R48.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaancgccaccctctcctgcagggccagtcagagtataacagcgacttagcctaggtaccagcaagaacctggaccaggcctcccgaggcctccgtcacttctagtggtcgcactcccaccgagggcccacgtcggactactcccgagcccgtaggttcaggtcggacgtaggtcggggtacgtggggaacctaggtaccgtttcggaccttccgttaccgaaccctacgtaccgacgacgtaaccggtccgtaacggaccgtaccgttaaggtaaacggtttagttttacggactttaaggtttttacttaagtttcggtaccgtaagtaccgtaacggaacccgtaaaacgtaccggtttcgggtaccccctttaacccgggtttacgggttaacccgggtttacccggaaccccgggttaaaacgggggtaaccccggttaaaaggggttaaaccggtaaaaaccgttaacccgggtaaaaaccggttacggttacgggtaaccgggttacctaccgggtaacccttaacccgttacgttttcccgttacgtttacccgtttcccgtaaccgttttacccccg

SEQ ID NO: 102283 - DNA, 699 bp, Homo sapiens
  misc_feature: GYAE6OF01D3RPR.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangcccaccctctcctgcaggccagtcagagtataacagcgacttagcctggtaccagacagaaacctggccaggctcccgaggcctcctcatctagtggtgacctactcccaaccgacgggccctacgtcggacactaccccgagacccgtacggttcaaggtcggcgtagggtcggggtacgtaggggaaccaacggtaccgtttccggacccttccgtacccacccgtaactccgaacgtccaacggacccgttaaggacgtacccgtaggtaaagtttacgtttttcggactttaaggttttattagtttcgtacgagacgtaacgaaccgaaaaccgtacgtaccggtccttaccgttacgggtaccgtttccgggaaccgaacggggtaaccgtaaagggttacggaaaaactaccggtaaaaccggtacgttagggtacggacgtacgaacccgtacctaagttccgttacgttacttacctcgtttacccccg

SEQ ID NO: 102284 - DNA, 656 bp, Homo sapiens
  misc_feature: GYAE6OF01CRNTY.51.83.H06.1.454.CMB.1.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (610)..(610): a, c, t, g, unknown or other
  misc_feature (610)..(610): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggcctcccagatgccaccggacaaattgtgttgacacagtctccagtccaccctgtctttgtctccgaggggaaagcgcccacctctcctgcgagggccagtcagagtataacngcgtactagctggaccagcaagaacctggacaggcctccgaggctccnactctagtggncatcccacgagggccacgtcggacactcccaggcctaagggttcaggttcggctagggtgggttacacgggaactaggtaccttcggtctcctaccaaccacgtacgacgacgaccgtacctaacgggcgtaccgttaggtaaacgtttagtttacggaatttaaggtttttaactttgttacggaactaggaccgaagttaaccgaaaacttcggtcggtcccgttaccggtttaacggaccgggttcgaacccggaagggtaactaagggtaagtaaaacctaccgtaaaaacgtcggttagtacggngttacgacctaaccgtcttacttacgtcttaacgtcttacccccgg

SEQ ID NO: 102285 - DNA, 660 bp, Homo sapiens
  misc_feature: GYAE6OF01CKKYP.51.83.H06.1.454.CMB.1.raw
  modified_base (159)..(159): a, c, t, g, unknown or other
  misc_feature (159)..(159): n is a, c, g, or t
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (489)..(489): a, c, t, g, unknown or other
  misc_feature (489)..(489): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttnacacagtctccagtccaccctgtctttgtctccgaaggggaaacncgccaccctctccgtgccagggccagtcagagtataaacngcgtacttagcctggtaccagcaagaaacctggccaggcctccgagcctcctcatctagtggtcgcacgtcccaccgaagggccaagtcgctaactccccagaccgaggttcaacggtggacagggttggtcgtaggggactaggacctttgctctcgaacctntaccgancacgcctaagcgtactagaacgttgtttacgacttagtttactttagtacgtacagtaacacgaaccgtaaacnccggttacgcccttacgtttacgggtaccgttaccgggaccgtaacggaaccggtaaggttaaccgaaaacgttacccgaaaaacggttaaacgtccgggttacggaaccgttacgacccttaaacccgtagtttcccgttccggtttaacttcccggtaactttcccccg

SEQ ID NO: 102286 - DNA, 759 bp, Homo sapiens
  misc_feature: GYAE6OF01BOLUT.51.83.H06.1.454.CMB.1.raw
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (321)..(321): a, c, t, g, unknown or other
  misc_feature (321)..(321): n is a, c, g, or t
tcagcgatcgtatacacgaccggtgctcgatttagatcacgtgcggtacggcgggggaggaactggctcgagttacggacccagagggaaccatggaagccccagtctcagcttctcttcctcctgctactctggctccagatgccacggtacaattgtgttgactacngtctcctagttcaccgtgtcttgtctcgagggaancgcctacctntccgtgcgagggccagtcagagtactaacgagccgtatacgccttggtaccagcaacgaaccgtcggccaggtcctcccgacggtcctccgtctattctagtggtcncctacgtcccgaccgacgggacccacgtcggaccgtaccgtacccgcgtaccggtaggtcgtaggtcgtacgtaagggtcgggtacgtagggtactaggtccgttacggtacctaccgttacgaacccttagtacgacgttacaccggtaccgttaggaaccggtaccgttaggtaaacgttacgttttacgaacgtttaaggttttacttaacggttcggttaacgacgtaaccggaaaccggtaaccgtaaaacgtaccggttccggttaacccgtccggttttaacgggacccggtttaaccgggaaccggtaaacgggtaaccgttaaaggggtaacgtaaaaccgtaaccgaaacggtaacgttgggtaacgtccgtaacgtaccctaacggtttacttcgttaacgttccgttaacctcgtttaacccccgg

SEQ ID NO: 102287 - DNA, 658 bp, Homo sapiens
  misc_feature: GYAE6OF01BBB71.51.83.H06.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctccagatcgccaccggacaaattgtgttgacacagtctccagtccacctgtctttgctcgagggaaancgccacctctctgcgaggccagtcagagtaataacgagtacgacttagccgtaggtaccagacaacgaaacctggccaggcctcccgaggtcctcctcatctagtggtnctatcccacgacgggtccacgtcggacaccgtcccgacgtccctaggttccaggtcggacgtagggttcgggtcgtacggggaactacgtaacccgtttcggccttaccgtacccgtaacctacgttaccgaacgaccgtaacgtaccgtaacggacgtaccgttaggtaacgttagttttacgacttaagttttaattcgttacgtacacgacgtacgtaaccgaaacgtctcggtccccgttacgtacgggttaccgtccggtaaccgaacgggtaaaccgagttaacggaaactacgaaacgtagtggacggctacgatacctacgttctaggttctccgtcgtcccg

SEQ ID NO: 102288 - DNA, 621 bp, Homo sapiens
  misc_feature: GYAE6OF01EEO5R.51.83.H06.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccgagggaanacgccaccctctccgtagaacgggccagtcagtagtattaacngcgtacttacgcctggtaccagcacgaaacctggaccacggcctaccgaggcctcctcactctatggtgcactccgaccgagggccacgtcggctactcccagccgtaggttcagtcggactaggtgggtactagggactagtacttccggctccgtaccaccgatccgacgtaccgacgtaccctaggacgtcgtagtaagttactttagtcttaagtttattacgtgtactagtacgtaataacttaatacgtcgtacccttccgttacttacggtttacgacccggtacgggaacctagtacgtaggtaacgtacgtaaccgaaacggtacggtacgtcggcgtacgacctactacttactacgttcctcgttacccg

SEQ ID NO: 102289 - DNA, 636 bp, Homo sapiens
  misc_feature: GYAE6OF01A58DM.51.83.H06.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (389)..(389): a, c, t, g, unknown or other
  misc_feature (389)..(389): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaanagccaccctctcctgcagggccagtcagagtataacagcgacttagcctggtaccagcaagaacctggccaggcctccgaggcctccnactctagtggtgcactcccaccgagggccacgtggccactccccgagcccgaggttcaggtcggcaggttgggtcagggacaggtacttcgctctacacctntcagcacgcctaggacgtcctagtaagttcgttttagacgttagttttacgttagtttcgtactagcgtaacggaaccgtaaactaccgttacggtccccgttacggttacgggtaccggtttccgggaacccgtaaaggggacccgtaaaggggtacggtaaaacgtaaccggaaaacggtaaccgttggacggtcctacgaccctacccgtattcccgttaggttccttaccgtcgtttaccccg

SEQ ID NO: 102290 - DNA, 718 bp, Homo sapiens
  misc_feature: GYAE6OF01DNGW7.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcggcggggggaggaactgctcagttaggacccagagggaaccatggaagccccagctcagcttctcttcctcctgctactctggctccagatgccaccggacaaattgtgttgacacagtctcagtcaccctgtcttgtctccgaggggaancgccaccctctcctgcagggtccagtccagagttaattaaccgagccgtacttagcctaggtacccagcaagaaacctggccaggcctaccgaggcctcctcatcgtatcggtgctactcccgaaccgacgggccaacgtcggacctacgtcccgagcccgtaggttacgacggtggacgtacggttcggggtacgttacgggaactaggtacccgtttcggccttccaccgtaacctacgtacgacgtaccgacgtacccgtaacggtaacgtacccttaaggtaaaccgtttattttacggaactttaacgttttaagtttaacgttcgtttacgaacggtacgtaacggtaacccgttaaaacgtaaccggttccggtacccgtttaccgttacggggtacccgtttaccgggaaccgtaacggggtaacctaagggtacgaaacgtaaacgaaaccgtacgttggtacggtacgacgaccgtaaccgtcttactcgtacctttacacgtttcccgg

SEQ ID NO: 102291 - DNA, 799 bp, Homo sapiens
  misc_feature: GYAE6OF01CSH3I.51.83.H06.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccgaggggaagacgccaccctctcctgcagggccagtcagagtaattaacagcgacttagcctggtaccagcagaaacctggccaggctcccaggctcctnatctatggngcactcccaaccgaggggccctacgtgggacccacgttcccccgaggtaccccgtagggttttccgaaggttcgggacgagggttcggggtcgtaggggacaaggtacctttcggctccgtaccaacccgtatacccgaagaccctaacggtacccgttaacgggaacgtacccgttaacggtaaacggtttaacttttttacgggacccgttttaaggtttttaacgttttaagtttacggttaccgtaacggtaccgtaacggtaaaccgggtaaaaccgtaaacccgttaccgggtacccccgtttacccggtttacggggttacccgggtttaccggggaacccggtaaccggggtaaacccggttaaacggggtaacggtaaaacgtaaccggtaaaacccggttaaacggtacgggttaacgggtaccgtacggtaacccgaacccgttaacgttacccgttacggtttaccctttccgttaaccgtttacccccg

SEQ ID NO: 102292 - DNA, 711 bp, Homo sapiens
  misc_feature: GYAE6OF01BOLON.51.83.H06.1.454.CMB.1.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgcccaccggactaaattggtgttgacacagtctccagtcaccctgtcttgctcgagggaancgccacctctcctgcaggccagtcagagtataacagagacttagcctaggaccagcaagaaaccgtggaccaggcctcccgaggtcctcctacatcgttagnggtcnctactcccacgagggcccacgtcggctaacctcccgacgtccgtaggttccgaggttcggcgtaaggggttcggggtactaggggaacctaacggttccgttccggaccttcctacccgaacctagtccgaacgtcgaccgtacctaacggaccgtacgttaaggtaaagttacgttttacgacgtttaagtttttaacgtttacgtttacgtaccgtaacggtacgtaaacggtaacccgtaaaacctcggttaaccggtcccgtttacccgggttacgggtacccggtttaccgggaaccggtaacggggaaccccgtaaagggtaccgtaaaaacgtaccggaaacgtacgtggtacggctacgacctacgtacttacgttgttacttccgacttaccccg

SEQ ID NO: 102293 - DNA, 545 bp, Homo sapiens
  misc_feature: GYAE6OF01DPWC8.51.83.H06.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcaggggaaanagccaccctntccngcagggccagtcaagagtattaaacagcgacttagcctggtaccagcagaaacctggccaggctcccaggctctcatcgtaatggtncatccaccaggccactgcatccagcaggttcagtgcagtggtctgggacagacttgctcncaccatcagtcggctaagngctgaagattttgctagtttattatgtcgaananacgacgaaacaacgtacgtacgtccgtacggtacggtacgtaccgtaacggtaaccggtaaacggtaaggtaacgtaacgaaacgaaacgtacgtagtacgtcgacgacgacgtactactattctctcgtccg

SEQ ID NO: 102294 - DNA, 686 bp, Homo sapiens
  misc_feature: GYAE6OF01AMKFE.51.83.H06.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaggggaaagngcccaccctctcctgcagggccagtcagagtataacngcgacttagcctggtaccagcagaacctggccaggctccaggctctcatctatggtgcatccacgacgggccacgtggcactcccagcccgaggttccaggtggccgtaggtcggggtcgtggggaacaggtacctttccggcctcgtccaccatcgagcacgccgtagacgtcccagtaacgttatttcgacttagtttttattagttcgtacacggtacaggtaaccgtaaaccgtacgttaccggtcccgttaccgtttacggggtacccggtttacgggaacccgtaaacgggggtaaccccgtaaaggggttaccggtaaaaacgttaacccggtaaaacggtaaaccggttgggttaccgggtaccgttacggtaaaccccgtacccggtaaacttttccggttaccggttttacctttaccgtaccgttttaccccccgg

SEQ ID NO: 102295 - DNA, 620 bp, Homo sapiens
  misc_feature: GYAE6OF01EW8WY.51.83.H06.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgcccaccggacaaattgtgttgacacagtctccagtcaccctgtctttgtctccaggggaaagngccaccctctcctgcagggccagtcagagtataacagcgacttagcctggtaccagcagaaacctggccaggcctccaggcctcctcatctatggtncatccacgagggccacgtggccactcccagccaggttccaggtcggctaggtgggtcgtgggacagtacttcgctacnccaccatcagcacgtcctaagacgcctagaaagttattttgacgttaagttttaattagtttgtactagacgtaagaaccgtaaacctacgtcggacccctttcgggttacgggtaccgtttaccgggacccgaaacggggtaaccgtaaagggtaacggtaaaacgtaccgaaaacggtacgtaggttacgggccgtacgacctaaccgtacttacgttagttcccttccgtaacgttccccg

SEQ ID NO: 102296 - DNA, 687 bp, Homo sapiens
  misc_feature: GYAE6OF01C86MR.51.83.H06.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgctccgaggggaaancgcccaccctctcctgcagggccagtcagagtataacngcgacttagcctggtaccagcacgaaaccgtggaccacggcctcccgaggcctccctacatctagtgggtcnctactaccgaccgacgggccacgtcggacctactccccgacgccgtaggttccaaggttcggacgtaggttcggggtcgtaggggactacggtaccgttcgccttcgacctaacctactccgacgcgaacgtcccgtaaggacgtaccgtaggtaaagttattttacgactttaagttttatttagttcgtacgtagtacgaacgtaaccgaaactaacgtcggtcccgttacgttcgggaaccggtttccggaaccggtaacgggaaccggtaaagggtaacggtaaaaccgtaaccgtaaaaccggtacggttaggtacggtccgaccgtaacctaccgttacttacgttaccgttaccttccgtccgttacccccg

SEQ ID NO: 102297 - DNA, 718 bp, Homo sapiens
  misc_feature: GYAE6OF01BD1CQ.51.83.H06.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtataacagcgacttagcctggtaccagcagaaacctggccaggcctcccgaggcctcctcatctagtggtnctactcccaccgagggcccacgtcggacacgtccccagccctagggttccaggtcggcgagggttcggggtctacggggaacaggtaccttccgacttccgtaccaaccgtataccgaacgaccgtaacgtacccgtaaggaccgtacccgttaggtaaacgtttacgtttttacgaccgtttaagtttttaacgtttacgtttcgtaacgtacggtacgtaacggtaaccgtaaaacgtaccgttaccgggtaccccgtttaccggtttacggggttaccggtttacccgggaaccggtaaacggggtaacccgaaagggttacggaaaaccgttaaccgaaaaccggtaccgttacgggacggtccgtacggacctaacccgtattacccgttagttccctttacgtcctttaccccg

SEQ ID NO: 102298 - DNA, 691 bp, Homo sapiens
  misc_feature: GYAE6OF01EE1FJ.51.83.H06.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgttctttgtctccgaggggaaancgcccaccctctcctgcagggccagtcagagtataacngcattgcctgaccagcagaacctggccaggcctccgagcctcctntatctagtggcgctactcccgaccggacgggccacggtcggacctactcccgacggccgtacggttacaggtcggacgtagggtcgggtacgtagggacctacggtaccttcgccctccgtaccaccctagtaccgacgaccgacgaccgtaacggaccgtaccgttaggtaacgtttacgtttacgtaacgtttaattttaacgttaccgttagttaccgtaacgtacgttaaagttaacttaaacgttaaccgttaccggtacccttaccgttaacgttacccggttttacgggaacccggtacgggaaccgtaacggtcgtaagggaacgttaacgtaaaccgtaaacgtaacgttcggtacggacgttaccgtacctacctacttcgttcgttccgttaaccc

SEQ ID NO: 102299 - DNA, 715 bp, Homo sapiens
  misc_feature: GYAE6OF01A3319.51.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangccaccctctctgcagggccagtcagagtattaacngcgacttagcctggtaccagcagaaacctggaccaggctcccgagctcctcatctatggtgctactaccaccgacgggccactggcactccccagcctaggttcaggtcggcgtaggttgggtcgtacgggacctaggtacctttccggccttacctaccgaccctaacgttccgaacggtccgtaacggacccgttaaggacgtccgttaacggtaagtttacgttttcggactttaagttttaacttttgttacgtcgtacgtacgaacggacgtaaaaccgtccgtacggtacccctttaccgggttccgggtaaccgggtttacccgggaacccggtaaccggggtaacccggtaaagggttaaccgggtaaaaaccgttaaccggtaaaaaccggtaccgttaggggttacggccgttaccggaccgtaaccttacgttctttaccggttcctttaccggtacctttcccccgg

SEQ ID NO: 102300 - DNA, 903 bp, Homo sapiens
  misc_feature: GYAE6OF01AIW30.51.83.H06.1.454.CMB.1.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggactaaattgtgttgacacagtctccagtcaccctgttctttgtctacgaggggaanacgcccaccctctcctgcgacgggccagtcagtagttaactaacngacgtacgttacgccgttggaccagaccaacgaaccgtcggaccgaaggccctacccggaaggtcccttcccgtactaacgttcgtagtcgggtcgaccacgttccccgaacccggtacggggccctacgtcggaccctaccgtccccgacggtcctacgggttcacggggtcggtacggtaaggggttcggggtacggttaacggggaccgtaacgttccgttccggtccttaccgaccctaacgtactccgaccggtactaccgggtaccgtaacgggaccgtacccggttaagggttaaactttacggtttttacggtaacgtttttaacgtttttaaggtttacgtttaacggtaccggtaaacgtaccggttaaacggtaaccccgggtaaaccgttaaccggggttttacccggtcccttttaacccgggggtttacggggttaaccccgggttaacccggggtaacccgggtaaacccggggtaaacggggttaaccggttaaaccggggttaaaaacccgtaccgggtaaaaacccgggtttacgggtaccgggtttaaaccgggtccctaacccgggttaaccctacccgtttaaccgggttaccgtacccgtttttaccctaacccgtttacccgtttaaccccccgg

SEQ ID NO: 102301 - DNA, 773 bp, Homo sapiens
  misc_feature: GYAE6OF01AR6JV.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanacgccaccctctcctgcagggccagtcagagtattaacagcgacttagcctggtaccagcagaaacctggaccaggctcccaggcctcctcatctatggtgcatccaccagggccacgtggcactccccgagcccgaggttcaggtggcgaggttggggtccgtagggggacctaggtaccgtttccggacctttccgtaccctaacccgtattcccgaaccggtctaacgggtacccgttaacggaacgtaccccgttaaggtaaacggtttaacgtttttacggtaacctttaaacgttttttaacgttttaaaccgtttacggttacccgtaaggttaccgtaaaggtttaactttaaaacgtttaacccgtttacgggtacccgtttaaccccggtttaacgtttaaccggttttttaccgggaaccccggttaaccgggggtaaccctaacgggtcccggtaacgggtaacggtaaacgttaaccccggtaaaaacgttaaccggttcgggttacgggtacgtaccggtacctaaccccgtaagtttcccgttggttccctttaccccg

SEQ ID NO: 102302 - DNA, 1068 bp, Homo sapiens
  misc_feature: GYAE6OF01BO9QF.51.83.H06.1.454.CMB.1.raw
tcagcgatcgtatacacgaccggtgctcgattttagatcacgtgcgtcgggacgggggacggaactggccttcgaggttagggaccctaggacgggaaccacggtcggaagccccagctcagcttctcttcctcctgctactctcggtctaccagtatgccaccggacgtaacttcgtagttcgaccacggaggtcctcgagtccgtacccgtgttcttgtctaccgaaggggaagcgaccctacctactccgtgcgacggggtcctaggttccgaaggtaaggttaacttaacgacggccgtaactttaccgaccgtagggtaaccacggaccgaaacggaaaacccgttcgggacccaacgggtcccgttacccggacgggtcccttaccctaaccgtaacttcccggttaaacggttcggggttacggaaccgtaaccggttacccccggaaaaccccggggtaacgggggtcccctaaccggttcgggtaacccccttaaccgttacccccggtacgggtaaccccggttaacggggtttacccgaaaccgggggttccccgggtaaccggttacggggggtaccgggggtttacccgttacgggggggtaaccgttaaccggggttaacccggtttcccgtacccgtttacccgttaaccccgtaacccggtaacgggtttcccggaaacgggtaccccggttaacccggtcccggttaaacggtaccccgtttacccgtaacggtaaaccggtttacgtttacccggaaccgtttaacggtttttaacgttaccgttacgtttacccggaaccgttacccgtaacggaaccccgtaaacccgttaaccggttacccgggtacccgttttaacccgggttaccggggttaaccccggtttacccgggggaacccgggtaaaccgggtaaacccggtaaccgggggttaaaccgttaaaacccggtaaccggtaaaacccggtccggttagggtaccggtaccgtaccggtaaccctacccgtttagtacccgttacgttaccctttccgtaccgttaccccgg

SEQ ID NO: 102303 - DNA, 724 bp, Homo sapiens
  misc_feature: GYAE6OF01CYEBZ.51.83.H06.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgagggaangccaccctctcctgcgaggccagtcagagtataacagcgacttagcctggtaccagcagaaacctggccaggcctcccgaggcctcctcatctatgggtcncactccaccgacgggcccagtggctactccccgagccctaggtacaggtcggacgtaggtcgggtcgtgggacacggtaccttccgcttcctcactacncgagaccgacgccgttaaggaccgtccctaaggtaaacgttaggtttttacgacgttttaacgttttagtttaacgtttgtacctaacggtactaacggtaaccccgtaaaacgttaacccgttaccggttaccccgttttacccggtttacgggtaacccgggtttaccccgggaaaccgggtaaccgggggaacccgttaaaacgggggacgttaaaaaacccgttaccggaaaaacggttaaccggttgggtaaccgggtccttacggaacccgtacctaaccgttcgttacctttccgttaaccgtcccgtttacccccgg

SEQ ID NO: 102304 - DNA, 718 bp, Homo sapiens
  misc_feature: GYAE6OF01ALQPA.51.83.H06.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (416)..(416): a, c, t, g, unknown or other
  misc_feature (416)..(416): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatcgccacggacaaattgtgttgacacagtctccagtccacctgtctttgtctccgaggggaaangcccacctctcctgcaggccagtcagatataacngcgtacttagcctaggtaccagcaacgaacctggaccacggcctccaggcctccncatctagtcggtagcactcccgacgacgggccctacgtcgactactacccgacgtccgtaggttcaggttcggcgtaggtgggtccgtagggacctacggtcctttcggcctaccgttaccaaccgngttacccgaacgccgtaacgtaccgtaacggtacgtacccgttaaggtaaacgtttacgtttttaccggacgtttaagtttttaactttaggtttcgtacgacgtacgtaacggtaaccgaaacctacgttacccggtcccttacgggttacggtaacccgggtttaccggaacccgggtaaacgggtaaccggttaaacggggtaacggtaaaaccgtaacggaaaccggtttaacggacgggttacggtccaccgtaacccgtacgtacgttcgttaccgttcttactcccgttaccccg

SEQ ID NO: 102305 - DNA, 534 bp, Homo sapiens
  misc_feature: GYAE6OF01D3Q1V.51.83.H06.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaacctggccaggctccaggctccnatctangtgcatccaccagggccagtgcatcccagccagttcagtggcaggtggtctggactagacttcgctctcactatcacgcacgctgctagtctagaatatttcgacttaatttactactggtctaagtctaagttataacgttaacgtcgtaccttaccgttactacgtttcgggcgtacgggacctaagtcgtaggtagactaccgaaacgtacgtaggtggtactgaccactacttgtgttacc

SEQ ID NO: 102306 - DNA, 773 bp, Homo sapiens
  misc_feature: GYAE6OF01DZAVL.51.83.H06.1.454.CMB.1.raw
  modified_base (219)..(219): a, c, t, g, unknown or other
  misc_feature (219)..(219): n is a, c, g, or t
tcagcgatcgtatacacgaccggtgctcgatttagatcacgtgcgtcgcgggggagaactgctcagttaggacccagagggaaccatggaacgccccagctcagcttctcttcctcctgctactctggcctccagatcgccaccggaactaattgtgttcgacactacgtcctaccagtcctacccttgttcctttcgtccgtaccggaaggggaaacnccgtcccctacccttcgtaccgtaggaacggcctaaggtcgaaggtaagttaacttaacgacggtcgttaacttacgccgtacggtaaccagaccgaacgaacccgtcggaccgtacgggacctacccgacggtccttcctactacttcgttaggtcggtcgtacctaccgtacccgaccggacggacccacgtcggacctaccgtcccgacgtaccgttacggttcgaggtcggtacgtaggttcgggtacggtaggaaccgtacgtaccgttcgaccttaccgtaccgtaaccgtacgttaccgaccgtacgtaaccgtaccggttaacggaccgtaccggttaagttaacgtttacgtttacggtaactttaagttttacgtttagttccgtagtacgtacgaacgtaacgtaaccgtacgtcgtaccgttacggtaccggtaccgttaccggacgtaacggtacgtaaggtaacgaaacctacggaacgttaggtacgtacgacgttaccacgttaacgtcgttacgttcttactcctcttcccgtaccg

SEQ ID NO: 102307 - DNA, 711 bp, Homo sapiens
  misc_feature: GYAE6OF01C2TEC.51.83.H06.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgcccaccggaactaaattgtgttgacacagtctccagtccaccctgtctttgtctccgaggggaancgcccacctctccgtgcgaggccagtcagatatacgngcacttagcctaggaccagcaagaaccnggccaggcctccgagcctctcattctagtggtcacacctccgaccgacggcctacgtcgaccactcccgagtccgaggttacaggttcggacgtagggtcgggtacgtaggggactaggtacgttcctaccgtcctacaccgtatacgacgacacggtccgttacgaccgtagtcgtaaggtaacgtttatttacgaactttaagtttacgttaacttacggtacctaagtacgttaaacgttaacgttaacgttaaccgttccggttacccgtttacccgttaacgtttacccgtttaccgggacccgggttaaaccgggtacgtaaaccggttacggacgggtaaaccgttaaaccgtaaaccggtaaaaccggttcggttaccgggtacggtacgttacccgtaaccgtacccggttactcggttttaccgttaccccg

SEQ ID NO: 102308 - DNA, 695 bp, Homo sapiens
  misc_feature: GYAE6OF01C5TVA.51.83.H06.1.454.CMB.1.raw
  modified_base (197)..(197): a, c, t, g, unknown or other
  misc_feature (197)..(197): n is a, c, g, or t
  modified_base (419)..(419): a, c, t, g, unknown or other
  misc_feature (419)..(419): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctcgaggggaancgccaccctctcctagaagggccagtcagacgtaattaacgagcgacttacgcctggtaccagcaagaacctggaccacggcctccgacggctcctcatctatgaatgacactaccgaaccgaacggggccctacgtagtaactacgttaccccgagccgtaagggttctacggtggacgaggttgggtcgttgggaactaggacgttcaccgtactcaccntaccgagcacgcctaggactacgtactaggtaacgttagttttcgaaccgtttaattttaacgtttacacgttactaacggttacctaaggtaaacttaaacgttaaccggtaccggttacccgttaccgtttaaccttaccgttttaccgggacccgtaacgggggtaaccgtaacggtacggtaaccgggaagtaaaccgtaaccgtaaaaccggttaacgtacggttaacggacgttacggaacccgtactaccgttccgtacggtttaaccc

SEQ ID NO: 102309 - DNA, 656 bp, Homo sapiens
  misc_feature: GYAE6OF01AI7PA.51.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (644)..(644): a, c, t, g, unknown or other
  misc_feature (644)..(644): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaagngccacctctcctgcagggccagtcagagtattaacngcgacttagcctggtaccagcgaagaaccgtggccaggcctcccgaggtcctcctcactctagtggtgcatcccaccgacgggcccacgtggcctacgtccccaggccgtaaggttcgaggttcggcgtagggtcgggtcgtcggggaacacggtacgttccgccttcctaccgtaccatccacggtcaccggtaccttaggacgtcccgtaagaaacggtttgtttcgacgttaagtttttattacgttcgtacaagtacgacggtaaccgtaaacgtacgtccggtcccttacgtagggtacccgttacggacccgtaaggggacccgtaaagggtacgaaaacttaccgaaaaccggtacgttgggactcccgagtccccgacttacgtccttacgtccctttcnccgtttaccccg

SEQ ID NO: 102310 - DNA, 736 bp, Homo sapiens
  misc_feature: GYAE6OF01C55FM.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaaggggaaagacgccaccctctcctgcagggccaggtcagagtattaacagcgacttagcctggtaccagcagaaacctggcaggctccaggctcctcatctatgtgcactccgaccagggcccactcggaccactcccagtccaggttcaggtggccaggtcggtcgtgggacacgtacttcggctcctacacctactcgaacgcacgacccttagacgtccgtagtaaagttacttttggaccttaagttttaagtttaacgtttcgtacgaagtaccgaaaggtaccgtaaaaaccgtaccggttaacggggtccccctttaaccgggtttacgggttaaccccggttttacggggtaacccccggaaaacggggggtaaaaccccggtaaaggggtttaaccggggaaaaaaccgtttaaccggaaaaaaccccgggttaacgtttcggggtaaccggtaccggttaccggtaacccgaaaccccgttacgtaccggtttaccggtttccctttaaccggtaaacctttttcccccccggg

SEQ ID NO: 102311 - DNA, 833 bp, Homo sapiens
  misc_feature: GYAE6OF01A9NIK.51.83.H06.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcacctgtcttgctcgaggggaancgccacctctcctgcagggccagtcagagtattaacngcacttagcctggtaccagcaagaacctggccaggcctcccgaggcctcctcatctagtcggtnccactcccgaaccgacgggcccacgtcgggaccaactccccgaaggtcccgtagggttccaggggttcggaccgtagggttcggggttaccgtacgggggaacctaacggtacctttccggccctttaccgtaccgaaaccctagttacccgaacggtaccgaaccgtacccgttaagggaccgtacccgttaagggtaaacggtttacgtttttacggaaccggttttaaggttttttaacgttttacgttttacggttaccgttaacgggtacccgtaaacgggttaaacccggtaaaaacccgttaaccggttccggggttaccccctttaccggggtttacgggttaaccccggggttttacccggggaaacccgggttaaaaccgggggtaaccccggtaaaaggggttaaaccggtaaaaacgttaacccggtaaaaaccggtaaccggttacgggtacggggtaccttacgggaaccctaaccggttacttaccgtttacggtttccctttacccgtccgtttacccccg

SEQ ID NO: 102312 - DNA, 648 bp, Homo sapiens
  misc_feature: GYAE6OF01AQTQ3.51.83.H06.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtcttgtctccgagggaangccaccctctcctgcaggccagtcagagtataacagcgacttagcctggaccagcagaacctggccaggctccagctcctcatctatggtncatccacgaggccactggcatcccgagcccaggttcagtcggnaggttcgggtcnggggacagtaccgtttcgcctctaccacctatcgagacctaacgccttaggaccgtcctaggaacgtattttcggactttagtttaactttaagttcgttacgtacggtactaggaccgtaaaacctacgtaccgggtacccgtttaccgtaggttacccggttacggacccggtaaaggggtaaccctaaaggggtaagaaaaccgttaacccgaaaacggtaacggttgggtaacggttacccgtaggtaccctaaacccgtacgtttaccgtacgtttaccgttaccgtaccgttacccccg

SEQ ID NO: 102313 - DNA, 805 bp, Homo sapiens
  misc_feature: GYAE6OF01E2HZM.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagcccaccctctcctgcagggccagtcagagttataacagcgacttagcctggtaccagcagaaacctggaccaggcctcccaggcctcctcatctatggtgcatcccgaccgagggcccacgtcggacacgtccccagcccgaagggtttccaggttcggcgtaggtcggggttctaggggaccaggtaccgtttcgccttaccgtccaccctatccgaacgtccaacgtcccgtaagaccgtacccgttaggtaaaacgttacgtttttacggtacctttaagttttttaaatttaacggttttccgttacgtaacggtacccgtaaacgggaacccggtaaaaaccgtaaccggttacccggggttacccccgtttacccgggtttaaccggggttaacccgggttttaaccccggggaacccgggtaaaaccggggggtaaacccgtaaaacgggggttaaacggaaaaaccgttaaaccccgaaaaaaccgggtaccgttaacggggttacggtacccggttaccgaaccccggtaaacccttaaccggtttaccgttaacccggttttaccctttccccggtaaacctttttcccccccgg

SEQ ID NO: 102314 - DNA, 727 bp, Homo sapiens
  misc_feature: GYAE6OF01BYRO1.51.83.H06.1.454.CMB.1.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaancgccaccctctcctgcaggccagtcagagtaataacagcgacttagcctggtaccagcaagaaacctggccaggcctcccgaggctcctcatctatggtgcatcccaccgngggccacgtcggcactcccgagcctaggttcaggtggactaggtgggtacgngggacacggtaccgttccgcgttcctaccaacctacttccgaagccgaacgtcccgtaaggacgtcccttaaggtaaacgtttcgtttttgaccgtttaagtttttaattttaggtttcgtaacgacgtaacgaacggtaaccgtaaaacctaccgttaccgggtcccctttacccgggtttacgggtacccgggttttaccgggaaccccggttaaacgggggtaacccgtaaaaggggttaacggtaaaaaccgtaacccggtaaaaaccggtaccgtttagggaccgggtccgttaaacggacccctaaaccggttacttaccgtttacgtacccgttttcgaaacccgttttccccccgg

SEQ ID NO: 102315 - DNA, 707 bp, Homo sapiens
  misc_feature: GYAE6OF01ETV91.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcacccttgtctttgcctcgaggggaaacgcgcccacctctccgtaggaagggccagtcaagtagttaataacagacgtacttacgccgttaggaaccagacgaacgaaaccgtggaccgaggcctccgaggccttcctacattctagttcggtcgaccactacccgaaccgtcggggacccacgtcggctactcccgagtacctaggttcgaggtggctagggtgggtacgtagggacacgtaccgttccgactccgtaccacgtacgtcgacgaccgtagaccgtagaccggtcttaacggtaaagtttacgttttagtaccgtttaagtttttacttacgtttcggtacaacgtccgaaacggaccgaaaccgtacgtccgttacccgttaccggttaccgggtaccggttccgggaaccgtaacgggaaccggttaaagggtaacgaaacggtaccgaaaacgggtacgtacgggtacgtcgacgtaccgaacttacgtcgttacgttacctttactcgtttcccgtcccg

SEQ ID NO: 102316 - DNA, 915 bp, Homo sapiens
  misc_feature: GYAE6OF01CSSWE.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgaccaccggactaaagttgtgttgacacagtcctccagtccacctgttctttgtccgtaccggaagggggaaacgtccgacccacccctcctcctcggcgacgggccagtcgaagtagttaattaacgagtccgtaacgttacgccgtacggtaaccagaccaaacggtaaccgtcggaccgacggtaccctacccgacggtcccttaccctacctaagttccgttaacggttcggggtctacccaacccgttacccccgaacccgggtaccggggacccgtaacccggttcgggaccccaaacccggttcccccgtaaccggtaccccggtttaacgggtttaccgaacggggttccggggtacggttaacgggggtttcccgggggtaccggtaacggggtaaacccgtaacggtttcccgtttacccggtcccttcccgttaaacccgaacccttaacggaccggaccgtaacccgaaccgggttaccgtaaccgggtaacggtaccccggtttaaggttaaagggttttaaccttttacggggtaaaccgttttaaggtttttaaagtttacgttacggtaacgtaccgtaacggtaacgaaaccgtaaaccgttaccggtcggtacccgtttaccggttaggaccgggttacccggaaacggtaacgggtaaccggtaaagggtaacgaaaacgtaccgtaaaacggtcggttaacggacggtccgtaacgtcctaaccctacgtcgtttactcctagtccccttacccgg

SEQ ID NO: 102317 - DNA, 777 bp, Homo sapiens
  misc_feature: GYAE6OF01AN7NQ.51.83.H06.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaancgccaccctctcctgcagggccagtcagagtataacagcgacttagcctaggtaccagcaagaacctggaccaggcctcccgaggcctcctacatctagtggtncatcccacgagggccctacgtcggacacgtccccaggtcccgtaggttccaaggtcggactagggtcgggtctaggggacaggtacgtttccaccgttactaccgaaccctattacccgaacggactacggtacccgttcgaccgtaacggttacccgttaagggtaaacggttaacgttttttaccggaaccttttaaaacgttttttaacgtttaacccttacggttaaccgtaacgtaccgttaaacggtttaaactttaaaccgtttaaaccggttacccgggttaccccgtttacccggtttaaacccgtttaccggtttttaccggggaacccggttaaccggggtaacctaaacgggtccgttaaacgggtaacgtaaaccggttaacccgtaaaaccgggtaaccgttacgggttacggtacccgttacggaccctaaccgtacgtttcgttccggtttaacccg

SEQ ID NO: 102318 - DNA, 762 bp, Homo sapiens
  misc_feature: GYAE6OF01CCFKI.51.83.H06.1.454.CMB.1.raw
  modified_base (710)..(710): a, c, t, g, unknown or other
  misc_feature (710)..(710): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaagcgcccaccctctcctgcagggccagtcagagtattaacgagccgacttagcctggtaccagcaacgaaacctggcccaggcctcccgaggccttcctctatctagtggtcgctactccgaccgacggccacgtggaccactccccgagccgtaacggttccgaggttcggacgtagggtgggtaccgtacggggactacggtaccttcggtacctacctacccgaacctaacgtccgtacgacccgacgtacccgttaagggaccgtccgttagggaaacgttttactttacggtacctttaacggtttttaatttacgtttacgtaccgtagtaaccgtaacgtaaacccgggtaaaaccttacccggtaccggttcccccgtttaccgggtttacggggtacccggtttaaccgggaacccgggttaacgggaacccggttaaaggggttcggaacgtaaaccgttaaacggtaaaccggttaagttaccggttaccggacccggttanacccccgttaacctacgtttacccgttacgtttccctttaacccgttacccg

SEQ ID NO: 102319 - DNA, 901 bp, Homo sapiens
  misc_feature: GYAE6OF01ESDE2.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggacaaattgtgttagacacagtctccagtcaccctgttcctttgtctaccgaaggggaaagacgcccaccctctccgtgcgagggccagtacagtagttaactaacgagacgtacttacgccgtaggtaccaggacaacggaaaccgtcggacccgtaggaccctcccgaacggtcccttaccctcgaacttccgttaagtcgggtcgacccgtactacccccgaaccggaccggggaccctaaccggtcgggacctaacctaccccgaaccggtaccggttaacgggtttcgaacgggttgggaccggtaacggggtttcggggtaccgttaggggaaccgtaacggttaccgttaccggtctacccgtacaaccctatccggaacacgaaccgtaccgtaagggtaacggtcccgttaaaggtaaacgttttactttttacggaaccttttaagggttttaaactttcgtttacggttacccgtaaagtaccggtaacgtaaaccgtaaaaccgttaccgttacgggtaaccccctttggggtttaccggttaaccggtttaccccggggaaacccgggtaaaccggggttaaaccgggtaaaagggttacggtaaaaaacccggtttaaccggaaaaaaccgggttcgtttaaaccggggcgggtaaaccccgttaagtacccccgaaaacccgttccgttttaacggtttcccttacccgttttaaccgttacccctttaacccccccggg

SEQ ID NO: 102320 - DNA, 758 bp, Homo sapiens
  misc_feature: GYAE6OF01BEIAK.51.83.H06.1.454.CMB.1.raw
  modified_base (195)..(195): a, c, t, g, unknown or other
  misc_feature (195)..(195): n is a, c, g, or t
  modified_base (729)..(729): a, c, t, g, unknown or other
  misc_feature (729)..(729): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccacctgtcttgctcgagggaancgccaccgtctcctgcgacggccagtcagtacgtaattaacagcgtacttagccgttaggaccaggaccaacgtaaaccgtcggaccacgggcctacccgaggccttacctctacttcgtacgtgggtcactacgtacccgaccgtaagggcccacgtcgggacctaacccgtccccgaagtaccgttacgggttaccaaggggtcgggtaccgtaggggttcgggggttaccgttacggggggaacccttaacggttacccggtttcccgtacttcccgttaacccggaacccttaacgtaccgaacgccgttaaccgaacccgttacggaccggtaacccttaggtaaaccgtttagtttcggtaatttaacggttttatttaagtcgttacgacgtacgtaacgtaaccgtaaacgtccggttacgtcccgtaggtttaccggacgttaccgggaacgaacgggtaccgaaagggttacgaaaaccttaaccggaaacgttcggtagacggttactacggaccttaacgtntaccgttcgttaccttctaacgttccccg

SEQ ID NO: 102321 - DNA, 703 bp, Homo sapiens
  misc_feature: GYAE6OF01DBACX.51.83.H06.1.454.CMB.1.raw
  modified_base (235)..(235): a, c, t, g, unknown or other
  misc_feature (235)..(235): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtccaccctgtctttgctccgaggggaaagcgccaccctctcctgcaggccagtcagagtataacngctacttagcctggtaccagcagaaacctggccaggcctccgagctcctnatctagtggtncactccagtccgacgggccagtcgaccactccccgaagcccgtaggttccaggttcggcgtagggttcgggtaccgtaggggaactacgtacctttcggtacctcctaccgtaaacctagttccgaacggtacccgtaacggtaccccgtaagggaccgtaccgtttaaggtaaacgttttaagtttttcggaaccttttaaggttttaactttagttcgtacgtagacgaacggaacgtaaaacgtacgttccggtaccctttacggttacgggaccggtttaccgggacgtaaacgggaacccggtaaagggtacgtaaacgtaaccggtaaaaccggtagttacgggtcggtaccgttacgacccgttaaccctagttcctttacgtcccttttacgtaccccg

SEQ ID NO: 102322 - DNA, 628 bp, Homo sapiens
  misc_feature: GYAE6OF01E3HCX.51.83.H06.1.454.CMB.1.raw
  modified_base (200)..(200): a, c, t, g, unknown or other
  misc_feature (200)..(200): n is a, c, g, or t
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
  modified_base (599)..(599): a, c, t, g, unknown or other
  misc_feature (599)..(599): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatgccaccggacaaattgtgttgacacagtctccagtccaccctgtctttgctccgaggggaaancgcccaccgtcgtccgtgcgacgggccagtccagtagtattaacacgcgtacttagcctggtaccgagacacgtaaaccgtggaccgaggcctcccaggcctcctgactcgtagtggcacacgtaccgacgagggcccagtcggaccactcccagccgtaaggttcgaggtcgngtaggtgggtcgtgggaccagtccttcgctacgtcaaccgtancgagcacgacctaggactactagtaaagttcttgtacttagtttattagttacgactagactacgtaaccgaaactacggtcgcccgtttacgtacggtacggttaccggacggaaacggtaccgtaaggtacggtaaaacgtaaccgaaaccgtacgtggtcggactacgacaccgttacncgtttacgtacccttgaccgtttcccccg

SEQ ID NO: 102323 - DNA, 779 bp, Homo sapiens
  misc_feature: GYAE6OF01BPQMT.51.83.H06.1.454.CMB.1.raw
  modified_base (206)..(206): a, c, t, g, unknown or other
  misc_feature (206)..(206): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggcctcccagatcgccaccggacaaaattgtagttgacacagtctccagtcacccttgtctttgctccgaaggggaaancgccaccctctcctgcgagggccagtcagagtaattaacagcgacttagcctagaccagcagaacctggcagctccaggcctcncatctatggtcncaacgtccacgaggccagtcggcaactccgagaccgtagttacgagnggcaggtcggggtcagggtacaacgtaccttcggaccttnacccgtaaacctatacgaagcctacggtaccctaaggtaccgtaccgtaagtaaacgttacgttttacggtaacgttaaggttttaacttacgtttaggtaacccggtaagtaccgtaaccgggtaaacccgtaaaaacgacccgtttacgggtacccccgttaaccgggtttaaccggggtaacccggttttaacccggggaaacccgggttaaaccggggaaaacccggttaaacgggggttaaacccgggtaaaaacgtttaaacccgaaaaacccgggttaaaccgtaaggggttaccgggtacccgttaacggaaccccgttaaacccggttaccttaacggtttacccggttacttttaaccccgaaccgttttaacccccggg

SEQ ID NO: 102324 - DNA, 752 bp, Homo sapiens
  misc_feature: GYAE6OF01A0VT7.51.83.H06.1.454.CMB.1.raw
  modified_base (729)..(729): a, c, t, g, unknown or other
  misc_feature (729)..(729): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgagggaaagacgcccaccctctcctagccagggccagtcagtagtattaacagcgtacttagcctcggtaccagcaacgaaacctggccaggtcctccccgacggccctccgtactactctaacgtcggtcgactacctccgaccggaccggacccctacgttccggacctaccctacccgacgtacccgttacggttacgtacgggtcgacggtgggttcgggtcgtacgggacgtcgttactccgtcttacccgtaccacgtacgtccgaacgtccgaaccgtccgaagtccgtacgtacggttaagtttacgtttacgtacgttttaagtttagtttagttaccgtcgaacgtacggtaaccggtaaaccgaaacccgttcggtacccgggtttcccttacccggggttaggtacccggggtttaccggaaccgggtaaaccgtaaccggggtaaaggtaaccggtaaaaccttaacggaaaaccggtcggttaggaccggtaccgtaccgtacccgactttacgtccggtttacnccttttaccgacccgtttacccg

SEQ ID NO: 102325 - DNA, 744 bp, Homo sapiens
  misc_feature: GYAE6OF01ERBRL.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgagggaangccaccctctcctgcaggccagtcagagtattaacagcgacttagcctggtaccagacaagaaaccgtggaccaggcctcccgagcctcctcatctagtggtcgcactcccacgacggccacgtcgcactcccacgccgtaggttccaggttcggactagggtcgggtcgtacggggactacggtaccttccggccttccgtaccgaccctacgttaccgaacggtaccctaaccggtaccttaagggaccgttacccgttaggtaaaaggtttacgtttttcggaaccgttttaagtttttaacgtttagttacgtactacggtacaacggtaaccgtaaacgtaccgttaccgggttacccttccgggtttaacggtacccgggtttacccgggaaccggtaaaccggggtaaaccggtaaggggttaaacggtaaaaccgtaacccgtaaaaaccgggtaacgttagggtacccggttaccgtacggtaaccctaacccggtactttaccgtaccgtttcctttaccgtaccgtttaccccgg

SEQ ID NO: 102326 - DNA, 896 bp, Homo sapiens
  misc_feature: GYAE6OF01CQGHA.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctcggcctcccagactcgcccgaaccggaactaaagttggtgttagacactagtcctccagtcctacccttggttctttgcctaccgaagggggaaacacgcccacctcctccgcgcggacggccaagtcaagtagtacttaacgacgtcgtactacgccgttggaccagacaacgaacgtcggacctacggcctccgacggtcctcctactacgttacgttaacgtcggtacgacctaccgtacccgaaccggtacgggtacccacggtccggacctaccgtaccccgacgtaccggtacggtttacgacgggttcggacgtaacggggttcggggtacggtacgggtaaccgtacggttaacctttccgggtcctttacccgtaacctaaccgttacgtaaccgtaccggaaccgttacccggtaaccggtaacgttaccggtaccggttaaaagtttacgggttttactttttacggaccgtttttaaaggttttagtttacgtttccgaataaccgggactaaacggtaaaccccgtaaaggttcccgttaccggttaacccggtttacccggggtttaccggaacccggggttttaccggaaaaccgggaaccggggttaaacccggtaaacgggggttaaaaccctaaaacggtaaacggttaaaaacccgggttcgttaggggacccgttaaaccgtaccgggtaaacccttaaaccttcggtttacgttaccctttacccgtacgtttaccccggttacccccg

SEQ ID NO: 102327 - DNA, 603 bp, Homo sapiens
  misc_feature: GYAE6OF01A8JNE.51.83.H06.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (250)..(250): a, c, t, g, unknown or other
  misc_feature (250)..(250): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
tcagcgatcgtatacacgaccggtgctcgatttagatcacgtgcggtcgcgggggaggaactgctcagttaggacccagagggaaccatggaagccccagctcagcttctcttcctctgctactctgcctccagatcgccgaccggacaaattgtgttgacacgagttcctccagtcctacccttgtctttgtcctcgaaggggaaacncgcctaccctntcctgcacggcaagtcagtagtacttaacngctacttcgccgtgtaccgagtcgaacgaaccgtgcccgaggcccgtaccgacgtcctccactatccgtagtggtccactccgtccgacgtacgggtccacgttcgccactcccgagccgtagtcgaggtccggatcggggttcggtcgcgggactacggtacctcgctacccgtcaaccngtaccnacncgacagcgtactagagtnttcgtgttacgttatcgtgtacngcgtacgtacaactcgtacgtcctcggtacgtcgtacggacgtacggtacgtaagggtacagtaaaccggaataggtccgtcgcctacgaccgacttgttctacgttctccgtcgttccccg

SEQ ID NO: 102328 - DNA, 953 bp, Homo sapiens
  misc_feature: GYAE6OF01EWR24.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtctccagtcaccctgtctttgtctcgagggaagcgcccacctctcctgcgaggccagtcagattattaacagcgacttacgccgtacggtaccagcgaacgtaaacccgtcggaccgacggtccctacccgacgggtcccttccctctaacttccttaaggtcgggttacgacctaccgttaccccgaacccggtacggggccctaaccggtcggacctaacccctccccgacgtaccccggttaacggttccgaacgggtcggtaccggtaggggttcgggggtaccgtagggggtaaccacgggttaacccgtttccgtccgttacctcccgaaacccgttacgtaccgtacggaccgtacccgtacccggttaagggaccgttacccggttaaaggttaacgtttacggtttttacggtaaccgttttaacgggtttttttaaactttacggttttacggtaacccgttaagggtaccggtaaacccgggttaaccgaaaaacccggtttaaccccgggtttaccgggttaccccccggtttttacgggttaacccggggggtttaacccccgggttttaccggggggaaaacccccggtaaaacccgggggttaaacccgggttaaaaggggtttaaaccccgggttaaaaacgtaaaaccccgggtaaaaccgggttaaccggttacggggttaaccggtccccgttaaaccgacccgttaaaccccgtttacgttccggtttaaccgtttccctttacccggtacccgtttttacccccccg

SEQ ID NO: 102329 - DNA, 672 bp, Homo sapiens
  misc_feature: GYAE6OF01D65VD.51.83.H06.1.454.CMB.1.raw
  modified_base (198)..(198): a, c, t, g, unknown or other
  misc_feature (198)..(198): n is a, c, g, or t
  modified_base (637)..(637): a, c, t, g, unknown or other
  misc_feature (637)..(637): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagccacctctcctgcagggccagtcagagtattaacagcgacttagcctggtaccagcagaaacctggaccacggcctcccgaggctcctcattctatggtcgactactaccaccgagggccacgtcggccactcccagacctaggttcaggtgcgtaggtcgggtcagggacacgtacttcgctctacgaccctagtccagtcgacgtccctaaggcgtaccgtaggtaagttacgttttagacccgtttaagttttatttactttcggtacacgtacgtaacggaaccgtaaaccgtaacttccgggtacctttacccgggtttacgggtaaccgtttccgggtaacccggtaacggggtaaccgtaaaggggtaaggtaaaaccgtaccgtaaaaaccggtcgttacgggtacggtccgtaccgacgtaaaccctnttacccgttacgttacctttcgacccgtttccccg

SEQ ID NO: 102330 - DNA, 747 bp, Homo sapiens
  misc_feature: GYAE6OF01B8AOF.51.83.H06.1.454.CMB.1.raw
  modified_base (207)..(207): a, c, t, g, unknown or other
  misc_feature (207)..(207): n is a, c, g, or t
  modified_base (704)..(704): a, c, t, g, unknown or other
  misc_feature (704)..(704): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtcctccagtccaccctgttctttcgtctaccgaaggggaaancgcccacccgtctcctgcgaggccagtcagagtataacgagcacttacgccgtaggtaccagacaacgaaacccgtggacccgacggcccttacccgacggtcccttacccgtactacttaccgtagttcggttcgacctaaccttcccgaaccggaccgggaccctacggtcggacctaccgtccccgtacggaccgttaggttaccgaggttcggacgtagggttcgggtacgtagggaacctacggtaccttcgcctacccttaccgaccgtacgtaccgacgtacgaccgttaccgtaacggtcgtacccgttaagaaccgttttagttacgtacgtttagttttaagtttgtacgtacgacgtacgaacggtaaaccctaacgtaccggttacgtacccgtttacggttacgggtacccggttacgaaccggtaagggaccgtaagggtaaacgtaaacgtaaccgggaaacgttggttacggacggtaccncggtaacctacctagttaccttagttcctaacgtcccttcccg

SEQ ID NO: 102331 - DNA, 794 bp, Homo sapiens
  misc_feature: GYAE6OF01EAX2P.51.83.H06.1.454.CMB.1.raw
  modified_base (574)..(574): a, c, t, g, unknown or other
  misc_feature (574)..(574): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaaccggacaaattgtgttgacacagtctcagtcacctgttcttgtcctacgaagggaacgcgcccacctctccagccgaggccagtaccagtaacgttaactaacgacgtcgtaacgtttacgccgttacggaaccaacggacgtaaaaccggaaaccgttcgggacccgaaccggtcccttaccccggaacggtcccttaccctacgtacttaccgttaaggtcgggttacgacccgttaaccgtacccggaacccggaccgggtaaccctacggttacggacctacccgtacccgaacggtaaccgtaaggttcccgaaggtcggtacggtaagggtcgggttacgaaggggaacctacgggtaccttacggcctactaccgtaacacgtaccgagaccgtacgtaccaaggactactagtaagttactttanacgtttaaggtttacttcggttactacggaactacgaaacggtaaccgtaaaccgtagtttcccgaccgtttcgggttaaacggttaccgggttacccggaacggtaaacgggtaaccggttaaacggtaaacggtaaaacgtacccgaaacggtaaacggttcgggacgtactaccgtagaccccgttaagtcgttcttaccggtacgtccttaacccg

SEQ ID NO: 102332 - DNA, 670 bp, Homo sapiens
  misc_feature: GYAE6OF01BYR2F.51.83.H06.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
  modified_base (390)..(390): a, c, t, g, unknown or other
  misc_feature (390)..(390): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatgccaccggacaaattgtgttgacacagtctccagtcaccctgtctttgtctccgaggggaaanacgccacctctcctgcagggccagtcagagtattaacngcgacttagcctaggtaccagccaagaaacctggaccaggctccgaggctcctcatctatggtncatccacgaggccactggcactccagcaggttcagtggctagggtcggtctagggactaaggtcttcggctctacgaccagtacgacncgacgttcaacggtacgccgttaaggaaacgtttacttttcggaaccttaagtttttaatacgttttaggcccaagggtccttaaaggaacccgtaaaacgtccggtttacgggcccctttaacggttcggggaaccgtttacgggaacccgtaaagggtacccgtaaagggtcgtaaaaactacccggtaaacggtaacgttcgggttaggaccctttaagggaccctaaacccgtagtttacccttacgggttcccttacggtaacgttttccccccg

SEQ ID NO: 102333 - DNA, 828 bp, Homo sapiens
  misc_feature: GYAE6OF01D0PFI.51.83.H06.1.454.CMB.1.raw
tcagcgatcgtatacacgaccggtgctcgatttagatcacgtgcgtcgcgggggaggaactgctcagttaggacccagagggaaccatggaagcccagctcagcttctcttcctcctgctactctggcctcccagatcgaccaccggactaaattgtgttgacacacgtctccacgtcctacccttgttctttgcctaccggaaggggaacaccgccctaccctcctccgtgacgacggccagtacgaagtagttaactaacgacgtacgtacgttacggaccgtacgtaccgagaccaacgtaaccgtcggaccacggtccctaccgacggtcctccgtactactcgttaggtcgtcacgtaccgtccgaacggaccggcctacggtcggacctaccgacccgtacggtaccgttacggttaccggtaagggtccggtaacggtggggttcggggttaccggtaaggggacctaacggttcctacggtaccgtaccgtacccaacggtacttacggaccgtacgtaccgtaccggtaagcgttacccggttaagtaaaggttttcgttacgtaagttttaaggttttaattcgttacggtacgtacgaccgtaacggtaacctaacggttaccggttcgttaacccgttcgggtttaaccgggaccggttaccgggaaaccgttacgggggaaacctaaacggggttaccgttaaaaccggaaaccttaaacggggtacccgttaggggttaccggtaccgtaccaaacccggttccgtttaacgttccgtttaaccggtttcctaacccgttaccgtttacccccg

SEQ ID NO: 102334 - DNA, 695 bp, Homo sapiens
  misc_feature: GYAE6OF01C6MGH.51.83.H06.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatcggccaaccggtactaaattgtgttagacactagtcctccagtcacctgttctttgctacgaagggaacncgaccacctcnccngcgacggccagtcagtagtataacgngacgtacttagccgtagtaccagacaacgaaaccgtcggaccacggtcctccgacggtcctacctacgatctagtggcacgactccgacgtaggcccagtcggactaccgccgagaccgtaggttcaggtcgacgtagggttagggtcctaggggaactaggtaccgttccgcgttaccacaactacgtacgacgaccgtaaacgcccgtaaggaccgtacgtagtaaacgtttgtttaacacgttaagtttttatacgtttcgacagtaacgaacgaaccgtaaagtccgtcgttacccgttacgttcgggaacccgttcggaaccgaacgggtaacgtaaacgggtaaacgtaaaacgttaacccgaaaagggtacgtcggtacgggtaactacggtacccaacggttacttaccgtaggtttaaccttccgaacgttttacccgg

SEQ ID NO: 102335 - DNA, 680 bp, Homo sapiens
  misc_feature: GYAE6OF01BD8SN.51.83.H06.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtcttgtctccgaggggaancgccaccctctcctgcgacgggtccagtcagtagtaataacagacgtattagccgtggtaccagcaagaacctggccaggcctacccgacggcctacctctatcgtagtggtcnctacgtccgaccgcgggccctacgtcggcctacgtccccagccgtaaggttccaggtcggacgtagggtcgggtacgtacgggactacgtaccttcgaccttacgccaacctagtcgaacgacctacggtacctagaccggtacctaagggtaactttacgtttagtactttaagttttagttacgttcgtacgacgacgtaagtaaccgtaaaccgtacggtaccgttcccgttaccggtttagggacccggtttacggaaccggtaacggtaccggtaaaggttacggaaacgtaaccgaaaacggtacgtggtaacggcttaccggaccttaacgtacttaccttagtcccttgtacccgtcccg

SEQ ID NO: 102336 - DNA, 816 bp, Homo sapiens
  misc_feature: GYAE6OF01DPRJC.51.83.H06.1.454.CMB.1.raw
  modified_base (218)..(218): a, c, t, g, unknown or other
  misc_feature (218)..(218): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatcgccaccggactaaattgtgttgacacagtctccacgtctacccttgtctttgtctccgagggaaacgcgccaccctctccngacgacggccagtcagtagtactaacagccgtacttacgccgtacggtaccagacacgaaaccgtcggaccgtacggtccctacccgaggtccttcctctacgttcgttagtcggtcgtctaccgtacccgaaccgcggacccgtacgtcggacctaacgtccccgacgtccgtaacggttctagggtacggtcgtacgggttcggggtcggtacggggactaacggtccgtttcggccttaccgacctaaccgtataccgaacgtcgtaaccgccgttaaacggcgtaccgttaaaggtaacgtttagttttaccggcgttttaaaggtttttacttaagtttaccggtaactacgggtaacccgtaacgggtaacctaaaacccgtaccggttaccgggtaccccgttaccggggtttcggtaacccgggttacccggaaccggttaaccggggaaaccgtttaaacgggaaacggtaaaaaccgttaaccggaaaaccgtttaacgggttcgggtaacggtaacccggttacgtaaccggtaacccgttacggttaccttccggtttaaccttaccggtaaccccttttcccggg

SEQ ID NO: 102337 - DNA, 728 bp, Homo sapiens
  misc_feature: GYAE6OF01AGOD2.51.83.H06.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (324)..(324): a, c, t, g, unknown or other
  misc_feature (324)..(324): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgctcgagggaancgccaccctctccngcgaggccagtcaagagtataacagcgtacttagccgtagtaccagacaacgaaacctcggaccctacggcctacccgaggtccttacccgtctaaacttcctaagtcgggttcncctacgtacccaaccggacgggccacgtcgaccaaccgtccccaacggtcctaggttacgacgggttcggacgtaggggttcggtaccgttaggggaacctacggtaccgtttcccggacctttacccgtaccaacctaacgtccgtaaccgaccgacgtccgtacgtacgtaacgggttacgtaacggtaacggttaacttttagtaaccgtttaaactttttaccgttacgttacgtacgtagttaacttaagttaacttaaatacccggttacgtacccttaccgtaacgtttacgtttacggacccggtacgggaactacggtaccgtaaggaacgtaacgttaacggaaaacggttcgtacggttacgaccgtacggtacacctacgttcttacgttcc

SEQ ID NO: 102338 - DNA, 565 bp, Homo sapiens
  misc_feature: GYAE6OF01AWBGG.51.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangccaccctctcctgcagggccagtcagagtataacngcgtacttagcctggtaccagcagaacctggccaggctcccaggcctcctcatctagtggtgcatcccaccgacgggccacgtggcactcccagcctaggttcagtcggctaggtgggtcgtgggacngtacttcgctctccaccatcagcagccgtagacgccgtagaacgttntttgacttagttttacttagttcgtcagcagaccgaaactacgtcggtcccttccgttaggtaccgttcggaccgaacgggacctaaggtagaaactacgaaacgtacgtggtacggctacgaccacgtacttcgtacttccttcgcttccccg

SEQ ID NO: 102339 - DNA, 830 bp, Homo sapiens
  misc_feature: GYAE6OF01EUQUS.51.83.H06.1.454.CMB.1.raw
  modified_base (203)..(203): a, c, t, g, unknown or other
  misc_feature (203)..(203): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctccagatgccaccggactaaattgtgttagacacgagtctccagtccaccctgtctttgctccgaaggggaancgccctacctctcctgaccgacgggccagtcaaggtagttaacttaacgagacgtaacgttacgccgttacggtaccagacctaacgtaaacccgtgggacccgacggcccttacccgaggtcccttacctacctagttaccgttaggtcggtcgacctaccaccccggacccggaacgggccctaacggtccggacctaccgtaccccgacgtaccgtaagggttccgaaggtcggtccggtagggttcgggtaccgaggggtacctaacggtcccgttcgtaccttccttaccgaaccgtactaccgggtaacgacccgtaacgtccccgtaagggaaccggttacccgttaagggttaaacgttttacgttttaccggtaacgttttaacgggttttttactttaacggtttcgtaacgttacgggtaactaaaccggtaaaccgtaaacgtccggttaccggttcccgtttaccgggttacgggtaccggttaccggaaccggtaacgggacggtaaacgggtacggtaaactaacccggtaaacgtacgggttacgggacgttcggacctaaccgaaccgtttctaccgggttactttcccggttaccttacccgttccccg

SEQ ID NO: 102340 - DNA, 717 bp, Homo sapiens
  misc_feature: GYAE6OF01BM149.51.83.H06.1.454.CMB.1.raw
  modified_base (186)..(186): a, c, t, g, unknown or other
  misc_feature (186)..(186): n is a, c, g, or t
  modified_base (705)..(705): a, c, t, g, unknown or other
  misc_feature (705)..(705): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggactaattgtgttagacacgtagtctccagttccacccgttnttctttcgtcgtaccgaaggggaaagcgccacccgtcctcgtcgcagggccacgtcagtagtattaacacgcgtactacgtccgtaggaaccagcgaacgtaaaccgcggaccgacggcccgttacccgaggcccgttccgtacgtacgttccgtagtcggttcgacgtaccgttcccaacggtccgggacctaccggtcggaccctaacgtccccgtaacgaccgtacgggtttacgacgggttcggtaccgttaagggttcggttaccggttaacgggtacgtaacccggtccggttcggaccctttacgtacctaacccgtagtttaccacggtacgaacgtacccggtacggtaccgtaccgtaggtaaacgtactttaaggtactttagtttagtttcgtcgtacacgtacacgtacgtactactcgtcccttcgtccggttacgtacggacgtacggaacgtagtacgaaacgtaacgacgtaagtcggacgtcacggacctacgtactcgtncttctcgttccg

SEQ ID NO: 102341 - DNA, 816 bp, Homo sapiens
  misc_feature: GYAE6OF01COPAO.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcgaaggggaaanacgccacctctcctgcaggccagtcaagagtattaaacgagacgtaactttagaccgtaggtaccaagacaacgaaaaccgtggccaacggcctacccgaaggtcctacctcacttctaagtcggtacacacgtacccgaccgacgggaccctacgtacggcctaacctaccccaacggtcccgtaaggttccaagggttcggacgtaacgggttcgggacgttaggggaactacggtaccttcggacctacgtacaaacctacgtaccgacgaccgaacgtccgttaaaacggacgttcccgttaaggaaacgttttaacgttttacgtaccgtttaaagtttttaaagtttagttttaccggacgttaaaggaccgtaaacggtaaaaccgtaaaacgttaaacccggtccgggttaacctttacccgggttacggggtaacccgtttccgggaaaccgtaaacgggggaacccgttaaaaggggttaaccgaaaaaccggttaaccgaaaaacccggggttaaacgttcgggaacgggtaccctaagggtaaacccctaacggttaacccttacgggttacgtttaaccctttacgtacccggttttaccccc

SEQ ID NO: 102342 - DNA, 595 bp, Homo sapiens
  misc_feature: GYAE6OF01BQBSQ.51.83.H06.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttagacacagtctccagtcaccctgtctttgctccgaagggaacncgccaccctctcctgcgacggccagtcagagtaattaacagcgacttagccgtggaccagcaagaacctggaccaggcctaccgaggcctcncactctagtggtnctactcccacgcggcctacgtcgcactcccagccgtagtcaggtcggcgtaggtcggtcgngggactagtcttcgctctacacctatcagacacgcctaggcgtacgtagtaagttacgtttacgacgtttagtttaacttgttcgtactacgacgtacgtaacgaaactcgtcgtacccgttcgtacggtaccgttcggacgtaacggacgaaggtacgtaaacaccgtaaacgtacgtagtcggtctacgaccctacgtcgttactacgttctccgtcgttaccccg

SEQ ID NO: 102343 - DNA, 566 bp, Homo sapiens
  misc_feature: GYAE6OF01BVKOT.51.83.H06.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (555)..(555): a, c, t, g, unknown or other
  misc_feature (555)..(555): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangcccaccctctcctgcagggccagtcagagtataacngcgacttagcctggtaccagcagaaacctggccaggctcccaggctcctcatctatggtgcatcccacgagggccacgtggcactcccagtccaggttcaggttcggcaggtgggtctgggactagacttcgcttcncacatcgagcgagtcctagcgcctagaagttntttgacttagtttacttagttcgtcagcaggaccaaactacgtcggtccttccgttacgggacgttacggaccgtaacgggaccgtaagggtagaaagtaccgaaagtaccgtggtacggtcgacgacctacctagttactcgttccttntcgttaccccg

SEQ ID NO: 102344 - DNA, 766 bp, Homo sapiens
  misc_feature: GYAE6OF01BEMMH.51.83.H06.1.454.CMB.1.raw
  modified_base (94)..(94): a, c, t, g, unknown or other
  misc_feature (94)..(94): n is a, c, g, or t
  modified_base (202)..(202): a, c, t, g, unknown or other
  misc_feature (202)..(202): n is a, c, g, or t
tcagcgatcgtatacacgaccggtgctcgatttagatcacgtgcggtcgcgggggaggaactgctcagttaggacccagagggaaccatggaanccccagctcagcttctcttcctcctgctactctggctcccagactgccaccggacaaattgtgttgacacagtctccagtcacccttgtctttgctccgaggggaaancgccctaccctctcctgcagggccagtcagtacgtataacgagtccacgttagccttggtaacccagacaacgaaaccgtgtacccgaggcctacccgacggcctaccgtaccactcctagtcggtcgccacgtacccacgtacgggacctacgtcggactaccgtcccgaacgtccgacgttacgacggtggaccgtaggttcgggtacgtggggaaccacggttacgtcgtaccttcgtaccaacctaagtccgagtaccgacgtacgttacggtacgtacccgttaagaacgtttacgtttagtaccttagttttaacgtttaagttagttcgagtaacgtacggtaaaccgtaaacgtaacgtccggtaccgttacccgttacggggttaacccggtttccggaaccggtaaacggggtaacccggtaaagggttaaccggtaaaacgttaaaacccggtaaacgttaaaccggttagggaacccggttaacgtacggtaaccccgtaaccgttaccgttaacgtttacggttcccttaaccgttcccgtttaccccccg

SEQ ID NO: 102345 - DNA, 823 bp, Homo sapiens
  misc_feature: GYAE6OF01BKKXW.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggacaaattgtgttgacacagtctcagtcaccctgtctttgtctccgagggaanacgcccacctctcctgcgacggccagtacagtagttacttaacgagtcgtacttacgcctacggtaccagacaacggaaaccgtcggaccgacggtaccctcccgacggtccctcctacgtacttccgttagtcgggtctaccaccttacccgaaccggaccggggaccctaacggtcgggaccctacccgttaccccgacgtacccggttaggtttaccggaacgggttcggtacggttacggggttccggggttaccggttaggggaaacccgttaacggtacccggtttacccgtaaccgtttccgtaacccaactaacgtccgacggacctacggtacgtacgacgttaccgttagtaacgtttacgttttacgacgttttaagtttatttacggttacgtacggtacgtaaccgaacggtaaacccgtaaaccgtaccggtccggtttacccgttaccgggttacccgggttaccggttaaccgggacccgtaaacgggtaaccggtaagggtaaaccggtaaagtaaacccgggtaaagtaaccggttagggacccggttactacccggtaacaccgtttcttaccgtacgtttaccttacgttccccgttaccccgg

SEQ ID NO: 102346 - DNA, 625 bp, Homo sapiens
  misc_feature: GYAE6OF01BPR28.51.83.H06.1.454.CMB.1.raw
  modified_base (200)..(200): a, c, t, g, unknown or other
  misc_feature (200)..(200): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaggggaanacgccaccctctcctggcagggccagtcagtagtattaacagcgacttagcctggtaccagcaacgaaaccgtggccaggcctcccgaggcctcctcatctagtcggtacgccactcccgacgacgggcccacgtcggccactcccgagccgtaggttcaggtcggcgtaggtgggtcgtagggacagtaccttcgctcctacgacctatcgacgcgacgtccaagacgtctagtaacgttntttcgactttagtttattacgtgtacgagtcgaacgacgtaaacncgttccgtaccttacggttcggtaccgttccggaaccggtaacgtaacggtaaggtaacgtaaacctaacggaaacgtcggttaggcggtctaccggaactaccgtagttccgttagttcccttcgtacccttccccg

SEQ ID NO: 102347 - DNA, 541 bp, Homo sapiens
  misc_feature: GYAE6OF01BF7T4.51.83.H06.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttagtctccaggggaaangccaccctntcctgcagggccagtcagagtattaacgagcgacttagcctggtaccagcagaacctggccaggctccaggctctcatctatggtncatccacagggccacgtggcatcccagccaggttcagtgcagtggtctggacagacttgctctcaccatccagcagcctagacgcctgtaagtatttacgctagtttattactgtcagcacgacgtaacacgtgactcgtcgtttcggcggtacgggaccgaagcgtacgaccgtccgtaggtccgacggacccgaacggtcctacggcccccttcgggacctacgttccgtccgttcccgtaccg

SEQ ID NO: 102348 - DNA, 880 bp, Homo sapiens
  misc_feature: GYAE6OF01B42WI.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctccagatgccaccggacaaattgtgttgacactagtctccagtccacctgttctttgtctcgaagggaatcgccaccctctcctgcgaggcagtcagagttactaacacgcgtacttacgccgtaggtaccacgacgaacgaaaccgtggaccgtacggacctcccgaggtccctaccgtcctattccgtagttcggtccgtactaccgttaccccgaaccggaaccgggtccccaaccgggttacgaccctaaccccgttacccccgaacggtccccggttaacgggtttccggaacgggttccgggaccgttagggggttccggggttacgttacgggggaacccgtacgggttaaccctttcgggtaccctccgttaacccgaacccgtaacgtcgaaccggtaccgtaacccggtaccgttaacgggtacggtacccgttaagggttaaacgtttacggttttaacggtaacgttttaacggttttttaagttttaacgtttaccgtaaccgtacggtacgtaaaccggtaaacccgtaaacgtaaccggttccggtaaccccgttttaccgggttacgggtacccgggtttacccggaaacggaacccggttaacgggtaaacgggttaacggtaaaaccgtaaccggtaaaaccggtaacgggttacggacggttcgacccggtaaaccgtacccgttaactacccggtttcctttaaccggttcccttaaccggttacccccg

SEQ ID NO: 102349 - DNA, 864 bp, Homo sapiens
  misc_feature: GYAE6OF01C1QEV.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgttctttgtctccgaggggaaacgacgccaccctctcctgcgacgggccagtcagtaagtattaacgagcgtacttacgccgtaggtaccagactaacgaaacctggaccacggtcctacccgacggtcctccctacacgttacctagttggtcgactaacctacccgaacccgtaacgggccctaacggtcggtaccctaaccgtaccccgacgtaccccggtaacgggtttccgaacgggttcgggtaccgtaagggtttcgggggtaccggttacggggtaaccctaaacgggttaaccgttttcccgggcccttttacccggaaacccgtaaacccgtacgtaccggtaacgtaccggtaaccgtaacccgggtaacgtaaccgtaacccggtaagtttaaacggtttattttacggtaccgtttaaggtttttaactttacgtttaccggtacgtaacggaaccgtaacggtaaccgtaaacgtaccggttaccggtacccgttaccggtttaacgggttacccggtaccgggtaacccggtaaacggggtaaaccgtaaacggggttaacgtaaaaccggttaaaccggtaaaaacgttaccggttagggtacggtaacccgtaacggaaccctaccgttaacgttccgttacgttaaccttccgtacccgtttaccccg

SEQ ID NO: 102350 - DNA, 743 bp, Homo sapiens
  misc_feature: GYAE6OF01EPYW5.51.83.H06.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
tcagcgatcgtatacacgaccggtgctcgatttagatcacgtgcgtcgcggggggaggaactgctcagttaggacccagagggaaccatggagccccagctcagcttctcttcctcctgctactctggctcccagatgccaccggacaaattgtgttgacacagtctccagtcacccttgtctttgctccgaggggaaanacgcccaccctctcctgcagggccagtcagagtattaaccngcacttacggcctgggtaccagcaagaaaccgtggccaggcctcccaggctcctcatctatggtcgctactccaccgngggccccaatcggacaccttcccgaacgcccgtaggggttaccaggttcggacgtaagggtcgggtcgttacggggacacggtacctttacggccttaccgttaccaaccctacgtaccacgtccgaacggtcccgttaaggaacggacccttagggaaactttacggttttacgtacgtttaaggtttttaaccgttaagtttcgtacgtacggtacgtaacggtaccggtaaaacctaccggttcgggtacccctttccggttacggggtaaccgggttttacccgggaaccggttaaacggggaacccgtaagggttaacgggaaaccttaaccggaaaacgggtaccctttaggggtaccggccggttagtaccgttaacgtaacgtttcgtaccgtttcttacccgtacgtttaccccg

SEQ ID NO: 102351 - DNA, 803 bp, Homo sapiens
  misc_feature: GYAE6OF01B6ER7.51.83.H06.1.454.CMB.1.raw
  modified_base (781)..(781): a, c, t, g, unknown or other
  misc_feature (781)..(781): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggactaaattgtgttgacacagtctccacgtcaccttgtctttagtctacgaaggggaacgacgccaccctctcctgcgacgggccagtcgagtagttattaacagcgtacgttacgccgtaggtaccacgcaacgaaccgtcggaccgacggtcctcccgacggtcctacctacgtactcgttacgtcggtcgactacctacccgaccggtacgggacccgtacgtacgacctacctacccgacgtaccggtacggttacgtacgggtacgggtacgtacgggtaggggttacggtacggggtaacgtacggttaccgttcgggtaccttaccgtacctaaccgtacgttacgaccgaccgtaccgtaacccggttaacgaccggtacctaaacggttaagtttacgttttacggtaccgtttaagtttttaccgtttagttccggtaccgaacgtcggtaacgtaaacccgtaacgttaacccggttcgggtaccccgtttagggttaccgggttaacccgggtaccgggaccgggtaaacgggttaccgtaaaacgggtaccggtaaacgtaacccgggtaaacggttaacgttgggttacggtaccgtaccgtacgtacctaggttacctttancgtttacccctcgttaccccgg

SEQ ID NO: 102352 - DNA, 811 bp, Homo sapiens
  misc_feature: GYAE6OF01AKR8P.51.83.H06.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtcctttgtctccaaggggaaancgccaccctctcctgcgaggccagtcagagtataacgngcgtacttagcctggtaccagcagaacctggaccaggcctccagcctcctcattctagtggtgcatcccgaccgngggacccacgtcggccagtccccaacgtccgtaggttcgacggttcggacgtacggggttcgggtccgtagggggtaccctaaggtcctttccggccctttaccgtaccctaaccctaagttccgaacggtacccaaggtacccgtaacggacgtaccccgttaaaggtaaacgtttaacgtttttcggtaacccgttttaaggtttttaatttttacgttacgggtttaccgtaacggtcccgtaaagggttaacccgaaaaccgtaaacccggttcgggtttaaccccgtttacccggttttacggggtaaaccccggtttaacccggggaaccccggtaaacggggtaaccccggtaaaggggtttaacggaaaaacgttaacccgtaaaaacgggtaacccggtttagggacccgggtaccttaaccggacccctaacccggttaactttccggttacctttacccgttttcccgttccccgtttaaccccgg

SEQ ID NO: 102353 - DNA, 778 bp, Homo sapiens
  misc_feature: GYAE6OF01C4D8F.51.83.H06.1.454.CMB.1.raw
  modified_base (232)..(232): a, c, t, g, unknown or other
  misc_feature (232)..(232): n is a, c, g, or t
  modified_base (752)..(752): a, c, t, g, unknown or other
  misc_feature (752)..(752): n is a, c, g, or t
  modified_base (770)..(770): a, c, t, g, unknown or other
  misc_feature (770)..(770): n is a, c, g, or t
tcagcgatcgtatacacgaccggtgctcgatttagatcacgtgcgtcgcggggagaactgctcagttaggacccagaggaaccatggaacgccccagctcagcttctcttcctcctgctactctggcctccgagatcgaccaccggaactaaagttggtagttagaccacgtacgttctaccgagtacctacccgttgttaccttttcgaccttaccggaaagggggaaacnccggtacccctacccgtctaccgttggaccggacgggccaaggttccgaaagtaacgttaacgttaaacgcgtacggtaaccgttaacgccgttaagggtaccaggaccgaacggtaaccgcggacctaggtacccgtacccgaggtcccttacctacggtacttacggttacgtacggtctaaccgtaccgtaacccgaccgggtaccggaccttacggtacggctaaccgttcccgaacgtccgtaggtaccgtaggtacggtacggttacgggtcgggttaacggtacgggtaccttacggtaccgttccgacttacccgtacacctaagtcgtaacgcgtacgacgtacgacgtcgtaagtacgttacgttgagtacgttagtacgttacgtgtaccgtagtacgtagttacgttcgtacgtaccgaccgttagaccggttacgtaaccggaggtaaccgacggttacgaaaccgtacgtaaaccggtgtacggtacgtcgttaccgactaccgtntacgttccgtacgttccncggttccc

SEQ ID NO: 102354 - DNA, 668 bp, Homo sapiens
  misc_feature: GYAE6OF01EU76J.51.83.H06.1.454.CMB.1.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
tcagcgatcgtatacacgaccggtgctcgatttagatcacgtgcgtcgcgggggaggaactgctcagttaggacccagagggaaccatggaagccccagctcagcttctccttcctcctgctactctggctcccagatcgaccaccggactaaaattgtgttgacacagtctccagtccacccttgtctttcgtcctccgaagggaaagcgcccaccctctcctgcagggccagtcagtagtataaccagccattacgctagtaccaggcaacgaacctgaccaggccgtccagctcctgatactagtggtacaccacgtcccgacgtacggacccacgtaggtccaactccccgagccctagggttcncggtacggcgtaggtcgggtcngggactcgtactgcctctacgctatccgagccacgtacctagactcgtagtaacgtacttagtacttagtttattagttacgtacacgtacgtaacgaaccgtaacgtacgtaccgggtcccttacgggtaccggtaccgggttacggaaccgaacgggtaaccgaaacgggttacgtaaaccgtaaccgtaaaacggtccgggtaggtacccggtcctaacgggtaccctaccggttactaccggttccttaaccggtttcctaacccggttcccg

SEQ ID NO: 102355 - DNA, 809 bp, Homo sapiens
  misc_feature: GYAE6OF01A9874.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggaacaaattgtgttgacacagtctccagtccacccttgtctttgctaccgagggaagcgccctaccctctcctgcgacgggccagtcgaagtagttaacttaacgacgtccgtacttacggcccgttacggtaccaaggcaacggaaacccgtcggacccacgggcccttaccccgaggtcccttaccctacgtacttcctaggtcgggtcgctaacccgtacccgaacccggacgggtcccctacggtccggaccctacctaccccggacgtaccccggttagggttccggaggtcgggtaccggtagggtccggggtacgttacggggaacgttaccgggtaccgtttccgtaccccgttccctaaccggtaacccctacgttacggaacttccccgaaccgggttacccgttaagggacccgttaacccggtaagttaacgttttacgttttacgggacttttaaggttttactttaacgttggtacctacggaaccacggtaacctaacgtaccggttccggttaccgttaccgggttcggttaacccgggttggaacccggaagggtaacccgggtaagttaacggaaaccgtagtaaaccggtcgtaggtacgggctaacggctaaccctgttaccgttcttcctcgtcccgttaccg

SEQ ID NO: 102356 - DNA, 752 bp, Homo sapiens
  misc_feature: GYAE6OF01BLIKN.51.83.H06.1.454.CMB.1.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccacggacaaattgtgttgacacagtctccagtcaccctgtctttgtctaccgaggggaaacacgccctacccgtctcctgcgagggccagtcagtagtataacngcgacttagcctaggtaccagctaacgaaaccgtggaccaggcctacccgacggcctcccgtcacttcttagtcgggttacnccgtaactccccgaaccggacggggtacccaacggtcgggacctaaccgtccccgaacggtcccggtaggttccgaacggtcgggtacgtacggggttcgggggttaccgtaggggaacctacgggttacctttaccccgggctttaccccgtaaccctaacccgtattacccgaacggtacccgaaccggtacccgttaaggacgtacccgttaaggtaaagtttacgttttaggaacctttaaggtttttaacttagttcttaggaacctacgaacgaaccgtaaacctacgtccggtaccttccggttacggtaccgttacgggaccgtaacggtaaccggtaaggtacgtaaacgtacgaaaccgttcgtaggacggtcgtacgaccctacgtattccgttagtcttacgtcttacccccgg

SEQ ID NO: 102357 - DNA, 860 bp, Homo sapiens
  misc_feature: GYAE6OF01B8TE5.51.83.H06.1.454.CMB.1.raw
  modified_base (214)..(214): a, c, t, g, unknown or other
  misc_feature (214)..(214): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctcggcctccagatcgcccaaccggactaaattgtgttagacacagtctccacgtccacccttgttctttcgtccgtacgaagggaaacncgccctacccctctccgtcgacgacgggcctaagtcaagtagtaattaacgacgtccgtaacttacgccgttcggtaaccgagaccgtaaacggaaaccgtcggacccgaacggtccctacccggacgtccctaccgacttacttccgtacggtggtacgacctaaccgccccgtaaccggaccggaccctacggtccgaccaaccgtcccgacggccgtacggtcgtacggtcggtcggtaggtcggggtcggacgggtacctacggtacgtcccgtacctaccgtacctagtccgaaccgtacggccctacgtaccggtaacgtaaccggttaccttaagggttaaacgtttctttaacggttacggttttaacgtttttagtttacggtttaaccgtgtaacccggttgtaaaccccgtaaaacgtaacccgggtacccttttaccggggtccccgttaacgggttacccgggtacccgggttaacccggtaacccggggtaaccggaaaccccgggttaaaagggtaaccggttaaaaccgttaaaccgggaaaaacgttccggttaggcccggttaacaacccgggtccttaaacgtcgttacccggttccgttacccgtttaaacgtccccgtttacccg

SEQ ID NO: 102358 - DNA, 671 bp, Homo sapiens
  misc_feature: GYAE6OF01AR4NF.51.83.H06.1.454.CMB.1.raw
  modified_base (313)..(313): a, c, t, g, unknown or other
  misc_feature (313)..(313): n is a, c, g, or t
  modified_base (661)..(661): a, c, t, g, unknown or other
  misc_feature (661)..(661): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagagccaccctctcctgcgagggccagtcagagtattaacagcgacttagcctggtaccagcaagaaacctggccaggcctcccgaggcctctcatctatggtgcatcccaccgngggcccactggcactcccgagcctaggttcaggtggacgtaggttgggtcgtgggactaggtaccttcgcttacgccaccctagtcacgtccacggtacccgtaaggacgtaccgtaagtaacgttactttttcggaaccgttttagttttaatttaacgtttcgtacgtaacggtcgtaacggtaaccgaaaaccgtaccgttccggttaacccgtttccgggttacggggtacccggtttacccgggaaccggtaacggggaacccgtaagggttaacgaaaccgttaacggaaaaccggtacgttgggtacggacgttcgaccctacgtacttcttcgtacttcncgtttccccg

SEQ ID NO: 102359 - DNA, 770 bp, Homo sapiens
  misc_feature: GYAE6OF01BS6TK.51.83.H06.1.454.CMB.1.raw
  modified_base (238)..(238): a, c, t, g, unknown or other
  misc_feature (238)..(238): n is a, c, g, or t
  modified_base (690)..(690): a, c, t, g, unknown or other
  misc_feature (690)..(690): n is a, c, g, or t
tcagcgatcgtatacacgaccggtgctcgatttagatcacgtgcgtcgcgggggaggaactgctcagttaggacccagagggaaccatggaacgccccagctcagcttctcttcctcctgctactctggcctcccagactcgaccgaaccggaactaaagtttggttagttacgaccactagttcctccgacgttccctacccgttgttacctttcgtccgtaccggaaggggaaacnccgccccacccttcctccgtcggaccgacgggcctaggtacaggtacgttaattaacgacgacgtacttacgaccgtacgtaacacgacgtaacgtaaccgtcggaccacggcctaccgacggtcccttacctactaattccgttaggtcggtactaccgtaccacccggacggcggacctacgcggactccgtaccgacgtaccgtaggtccgtaggtcggacggtcggggtcggtacggcggaacgtccgtactccgaccttaccgaccgtacgactacggacgacgtacgtaccgtaagtacccgtacgtaacggttaagtttctttacggtactttaaggttttaccttagtacggtactacggaagtaacccgtaacgaaacggtccgtcgtaacccgttgggtacggtaaccggtaccggaacggtaacgtaacggacgggtaaanaccgtaaacggacgtaaaggtgtaccggtcaccggtaacctacgttccgttaccgtatttacccgtccgttcgtaccccg

SEQ ID NO: 102360 - DNA, 841 bp, Homo sapiens
  misc_feature: GYAE6OF01C98LW.51.83.H06.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
tcagcgatcgtatacacgaccggtgctcgatttagatcacgtgcgtcgcgggggaggaactgctcagttaggacccagagggaaccatggaagccccagctcagcttctcttccctcctgcctactctggcctccagatcgccaccggactaaattgtgttgacacagtcctccagtccaccctgttctttgtcctaccgaaggggaaacncgccctaccctcncctgcgacggccagtcaagtagtatacagacgtacttagctgaccagaccaacgaaccgtcggccgaccggtcctacccgaggtcccttcctactacttctagttcgggtacgaccaccgtacccgacccggaaccgggaccctacggtcggaaccctaccgtaccccgacggtacccgtacggttacgacggtcggtacgtacgggttcggggtacgtacgggtaactcggtacctcgtccttacaccgtaacctacgaccgacgtaccgtaacggtacctaacggacgtacccgttaggttaaacgttatttttacggacttttaagttttattcggtttacgacgtaacggtaaccaacggttaaccgtaaaaccgttcgggtacccgttaccccgttttaccggggtacgggttaaccgggttaccgggtaaacccgggtaacggggttaaaccggtaaaacgggtttaaaccggaaaaccgtttacccgggaaaaaacccgtttaccggggttaagggttacccggtaccggttaaaccggtacccgtaaaccccgtttaggttttacccgttacccgtttccccgttacggttaacccccgttttcccccg

SEQ ID NO: 102361 - DNA, 872 bp, Homo sapiens
  misc_feature: GYAE6OF01DHRK2.51.83.H06.1.454.CMB.1.raw
tcagcgatcgtatacacgaccggtgctcgatttagatcacgtgcgtcgcgggggagaactgctcagttaggacccagaggaaccatggaacgccccagctcagcttctcttcctctgcttactctgctccagatcgaccacggaacaaattgtgttgaacacgtagtacctaccagtaccacccttgttctttacgacctaccggaaagggggaaacaccgaccctaacccttctccgtacgacgtaccgggaccaaggttacaagtaacgttaagtaacgacggtactaactttacggaccctagtaacccgacgaacgtaaacgaaacccgttggaccgtaacggccctaaccgcggtcccttacccagtacttccgtaaagttcgggtacaaccgtaccttacccgaacccgacgggtaaccctagttaccggaacctaacccggttccccgaacggtaaccggtacggttttacccggaaggttcgggtaacggtcggggggttttacgtaaccgggtacggggaaaaccgttaaccggttaccgttttcacccgttacccggtaactaaaaccgtacgtaccgaaagtaccgtaccgtaaccggtaacgtaccggtactaaacggtttaacggttaacgtttacgtaaaccgtttaagtttaccgtttaaaggtacttacgaaccgtaacgaacgtaacgaaacgttaccggtaccgtacccgttacgttccgggtaaccggttaaccgggaacggtaaacccggaacgggtaaacggtaaacggaaacgttaaaccggaacgtacgtaggtacggtacaacggaaccacgttcgttaactcggttacttaccggtaccttacccgg

SEQ ID NO: 102362 - DNA, 732 bp, Homo sapiens
  misc_feature: GYAE6OF01D3DB6.51.83.H06.1.454.CMB.1.raw
  modified_base (353)..(353): a, c, t, g, unknown or other
  misc_feature (353)..(353): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgcccaccggacaaatttgtgttgacacagtctccagtcaccctgttctttgtctccgagggaaagcgcccaccctctcctgccgagggccagtcagagtaacttaacagcgacttacgcctaggtaccagcaacgaaccgtcggccaggcctacccgacgtctcctcacttcctagtggtcgctactcccgaccggacgggacctacgtcggcncctacccgacgtccgtaggttcgaggtcggccgtagggtcggggtcgtacggggactacggtccgtttcgccttccgtaaccacctatacgacgccgacgacccgtaacggtaccggtccgttaaggtaacgtttacgttttcgtaaccgttttagtttttaacgttttcgttaggtaccgtaggtaaccgtaacgaacccgtaaactaccggttaccggtccccgtttacgggttaacgggtaccgtttacccgggaaccggtaaccggggtaacgtaacggggtaacgtaaaccgtaaccgaaaacggtacggttagggtacggtaccgtacgaacctaccgtacgttacgttaccttcgttacctcgttacccccg

SEQ ID NO: 102363 - DNA, 669 bp, Homo sapiens
  misc_feature: GYAE6OF01BQZM9.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtccaccctgttctttgtctaccgaggggaagcgcccacctctcctgcgacggccagtcagagtataacgagcgtacttacgcctaggtaccagcaacggaacctcggaccacggcctacccgacggtccctacctacgtactcgtagtcggtcgctacgtcccgaacggaccgggcctacgtcggacctaccgtaccgacgtaccgtaggttccgacgggtcggaccgttacgggtggggttaccgagggtaccacggttaccgtcgtccctaccgtaccgaaccctacgttacgaaccgtccgtacgttaacccgtaggaccgtacgttaggtaaacgtttcgtttagtacctttagtttattacgtgtacgatacgactacgaactcgtcgccttacggtcgtacggtaccgacgtaacggacgaacggtacgtaacgacgtaaacgcgtggtacgcggtacaccgtagtacttactacgttctcctcgttaccccg

SEQ ID NO: 102364 - DNA, 768 bp, Homo sapiens
  misc_feature: GYAE6OF01DR1QQ.51.83.H06.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatcgccaccggacaaattgtgttgacacagtctcagtcaccctgtctttgctccgagggaaancgccacctctccngcgagggccagtcagagtataacagccgtactgcctgtaccagacaacgaaccgtcggacctacgggccttaccccgaaggtcctacccgtacgtacttaccgttaaggttcgggtccgtacctaaccgttaccccggaaccggaccggggtacccctacggtaccggacctaaccttcccccggaacgaccggtaacggttacgacgggtcggccgtaagggtcggggtcgtacggggactacggtaccttcggtacctaccttaccaaccgtcgttacgacgaccaacggtcccgtaaggtaccggtcccgtaagttaaggttacgttttacgtacgtttaacttttaagtttcttaacggtctaacgccgtaaggtaaccgtaaacgtaacctccgggtacccgtttacgggttaccgggtaccgttaccgggaaccggacgggaaaccgttaaggaaaccggtaaacgtacgaaaaccggttaccggtagggtacgtccggtactaccggtaacccttagttaccggttactttaccttcgtaaccgttccccg

SEQ ID NO: 102365 - DNA, 944 bp, Homo sapiens
  misc_feature: GYAE6OF01ACF5A.51.83.H06.1.454.CMB.1.raw
tcagcgatcgtatacacgaccggtgctcgatttagatcacgtgcggtcggcgggggaggaactgctcagttaggacccagagggaaccatggaagccccagctcagcttctcttcctcctgctactctggcctcccagatgccaccggacaaattgtgttgacacagtctccagtccacctgttctttgtctccgaggggaagacgcccaccctctcctgcgacgggaccagtacagagttacttaacgagccgtacttacgtcctacggtaccagaccaacggaaccgtcggccaacggcctacccgacggtccctacctcacgttcctaggtcgggttacgaccaccgttacccgaaccggtcggggaccctacggttcggaccacctaccccgaggtccggttaacgtcgtacggtcggacgttacggggtcgggttcgtaggggactacggttaccgttccgtaccttcccgtaccaccctacgtaccgtaaccggccgttaacccggtaccggttaacgggtaccggttacccgttaagggtttaaaccggttttttacgttttcgggttaaaccttttttacggtttttttaaagttttaccgtttacgggtaacccgtaacggtaacccggttaaacccggtaaacccggttaaaaccgtttacccggggttcccccgttttaacccggttttaacccgggggttttaacccgggttaacccgggggtttaccccgggaaacccggggggtaaaccggttaaaccggggttaaacggggttaaacgggttaaaaacccgtaaacccggggtaaacccggtttaacgggtttacggggttaccgggtacctaacccggtacccgggtttaaacccttaccggtttttacccggtttaccttaaaccggtttcccggtttacccccttttacccccggg

SEQ ID NO: 102366 - DNA, 654 bp, Homo sapiens
  misc_feature: GYAE6OF01CS08U.51.83.H06.1.454.CMB.1.raw
  modified_base (310)..(310): a, c, t, g, unknown or other
  misc_feature (310)..(310): n is a, c, g, or t
  modified_base (637)..(637): a, c, t, g, unknown or other
  misc_feature (637)..(637): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgaggggaagacgcccaccctctcctgcgaggccagtcagagtataacagcgacttagcctggtaccagcaacgaaacctcggccacggtccccacgcgtcctctatctataggtgcacnccaccgacgggaccgaccgcgcgactaccccgacgaccgacggtttcgaggtacggcgaggttagggttccggtacggacggtacgtacgtccgttccgtcctaccaccactaccacggcaacgtaccgtacgacgctacggtaagttagtttcgtactagttttattacttgtacagtcgacgtacaaacgtactccgccgttccgttacgggtacggttacccggtaaccgaacgggaacggtaagggttaacggtaaacgtaaccggtaaacgtaaacggtcgtagggacctcggacacccgtaattcgttacgtctttaaccnccgttccgttacccccg

SEQ ID NO: 102367 - DNA, 763 bp, Homo sapiens
  misc_feature: GYAE6OF01AZNKN.51.83.H06.1.454.CMB.1.raw
  modified_base (298)..(298): a, c, t, g, unknown or other
  misc_feature (298)..(298): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgcccaccggacaaatttgtgttgacacagtctccagtcaccctgtctttgtctccgaggggaaagacgccaccctctcctgcgagggccagtcagagttataacagcgacttagcctggtaccagacaacgaaaccgtggccgaggcctcccaggcctccncatctagtggtgcactccaccgacgggcccacgtcggcctaccgtaccccgaggcccgttaacggttccgagggttcggaccgagggttcggggttacgttaggggaacctaggtaccgtttccggcccttaccgttacccgaacccgtagttacccgaacggccgtaacccggtacccgtttaacgggacgttaccccgttaagggtaaacgtttacggtttttacgtaaccgtttagttttttaaactttagtttacggttacgaacgtacgaacggtaaccgtaaaaccgtaccggtaccggtttcccggttacccgtttaacggggtacccggttaccgggaacccggaacgggtaccgtaagggtaaccgttaaaactacggaaaaccggttacgtggtacggtccgaccgtaccgtaccgtacgttccttacgtttcccttacgtccgtttacccccgg

SEQ ID NO: 102368 - DNA, 698 bp, Homo sapiens
  misc_feature: GYAE6OF01AZBB1.51.83.H06.1.454.CMB.1.raw
  modified_base (226)..(226): a, c, t, g, unknown or other
  misc_feature (226)..(226): n is a, c, g, or t
  modified_base (554)..(554): a, c, t, g, unknown or other
  misc_feature (554)..(554): n is a, c, g, or t
tcagcgatcgtatacacgaccggtgctcgatttagatcacgtgcgtcgcgggggaggaacgtgctcagttaggacccagagggaaccagtggaagccccagctcagcttctcttcctcctgctactctggacctccagatcgccaccggtacaaattgtagttcgaacacgtagtcctccgacgtaccacccttgttctttcgttccgtaccgaagggggaaaacncgacccctacccgtctccgtcgcgacgggccagtcaggtactagttaacacggctacttacgcttacggtaaccaggacctacgaaaccgcgtccgagcctccgacggcctcgtcactgtactggctaccgactccgtaccgacgggtaccacggttacggccactacccgagtacctacgtacggtcgtacggctaacggggtcggtaccggtacgggaccgtaacggttccgttacggtcttacccgtacgaccctagtcggataccggacgtacgtagaccgtactagtacgttagttctagttagtttacttagctagaccgtnaacgtacaacggtacttcggacctttcgggttaccggacgtttcgaaccgggtagtaaccgggaaggttaggtaaccaacggtaaccggaaacgtcggtacgcgacctaacgactaggttcctaagtcccttatccggtacccg

SEQ ID NO: 102369 - DNA, 755 bp, Homo sapiens
  misc_feature: GYAE6OF01CWD16.51.83.H06.1.454.CMB.1.raw
  modified_base (204)..(204): a, c, t, g, unknown or other
  misc_feature (204)..(204): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatcgccaccggactaaattgtgttgacacagtctccagtccaccctgtctttcgtcctccgaggggaancgccacctctctgcacggccagtcagagtactaacagcgtacttacgccgtacggtaccagtacaacgtaaaccgtcggaccaacggtcctacccgacggtccttccgtacactcgttaagtggggttcacgtaccgtacccgtaccggaacgggtccctagtccgggacctaccgacccgtacgaccggtaggttacgacgggttcggacggtacggggttcggggtaccgttaggggaaccgtacggtaaccgttcccgtaccttaccgtacctacgtaaccgtaccgacgtacccgtacggtacccgtaaggaccggtaccgttaacggtaacgtttacgttttacgacgttttacgtttaagtttacggttacgtacgtacgtacgaacgtaaccgaacctaaccggtcggtacccttaccggttcggtaccggttaccggaccgtaacgggaaccgtagggtaccgtaaacgaacggtaaccgtacgtagtggtacccgtacgacgtaccgttaacgttcccgttagttccctcgtcccttacccg

SEQ ID NO: 102370 - DNA, 773 bp, Homo sapiens
  misc_feature: GYAE6OF01AMQTB.51.83.H06.1.454.CMB.1.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagcgatcgtatacacgaccggtgctcgatttagatcacgtgcgtcggcggggggaggaactgctcagttaggacccagagggaaccatggaagccccagctcagcttctcttcctcctgctactctcggctcccagatcgccaccggacaaatttgtgttgacacagtctccagtccaccctgttctttgtctccgaaggggaagacgcccaccctctcctgcgacggcagtcagtatataacngcacttagcctggaccagccaagaacctggccaggcctcccgaggcctccncntctagtggtcncatcccgacgacgggccacgtcggacctaccgtccccgtaacgccggtaacggttccgaaggggttcggaccgtaaggggtcggggttaccggtacggggtaaccacggtaccgtttcccggccttaccgtacccaacctacttaccgacgtaccgtaccggaccgttaacggaccgtaccgtaaggttaaacgtttagttttcggtaacgtttaacgtttttacgtttaagttcgtaacgtacctacggtaacgaacccgttaaaccgtacggttaccgggtaccccttttaccggggttacgggtaacccggtttaccgggaacccggtaacggggtaacccggtaaacggggttacgtaaaaccgtacggaaaacccgggttacgttagggtcggtaccgttaccggacccttaacttaccgttacgttacgttacccttccgttacccgtttcccccgg

SEQ ID NO: 102371 - DNA, 805 bp, Homo sapiens
  misc_feature: GYAE6OF01BRYL6.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggactaaattgtgttagacacagtcctccagtccacccgttgttctttcgtcctaccggaaggggaaacgacgtcccacccctctcctgcgacggccagtcagtagtacttaacgacgtccgtaacttacgtccgtacggtaaccacgaacctaaacgaaaacccgtcggacccaaccggtccctacccgacggtccctccttacctacgttccgttagttacggcgaacctaccgtaacccaccgggaaccggaccgtaacggtccggaacctaacccgtccccgaaccggtaccgttaacgggttaccgaacggtcgggaaccgtcggggttcgggtacgggtacggacgtaacgtaccgttaccgtccctaccgtaccaacgtaactccgacgacgtacggtccttaaaggccggtacctaggttaaaccgtttagttttaacctacggttttaacttttatttacggtacggtacgtaacgacgtaaacggaaccttaaaccgcccggttacgtaccccgttcgggttaccggaaccggtttacccggaacggtaaacggtccggtaaaagttaccggaaagtaacccgaaaggttcgtacggcggtaccacggaccttacctacgttcttacggttacctccgttcgtacccccg

SEQ ID NO: 102372 - DNA, 704 bp, Homo sapiens
  misc_feature: GYAE6OF01CCKSO.51.83.H06.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (421)..(421): a, c, t, g, unknown or other
  misc_feature (421)..(421): n is a, c, g, or t
  modified_base (520)..(520): a, c, t, g, unknown or other
  misc_feature (520)..(520): n is a, c, g, or t
tcagcgatcgtatacacgaccggtgctcgatttagatcacgtgcgtcggcgggggagaactgctcagttaggacccagagggaaccatggaacgccccagctcagcttctcttcctcctgtctactctggcctccagatcgccaaccggtanaaatttggtgttagacacagtcctcagtccacctgttcttagctaccgaaggggaaacncgcccacctctcctgcgnggccagtcagtacgtactaacacggtctaacgtacgccgtacggaaccagacgaacgtaaaccgtcggaccgaacggtcccgtaccgacggtacctccgtcaacttctaaggtaggtcgtactacacccgaacggtaccggaccacgtcggacctaccgtaccacgcctaaggtcgtaggcggtactagggnggtactagggaccagtaccgtcgtacgtactacgactactcgagaccgacgtacgtagaccgtacgtagtaacgttacttacgtatttaacgtttaatntttacgactaggaacgtaacgtaaccgtaacgacgttacggtaccgttccggtagtaccggtaccggaaacggtaacgggaacggtaaggtaaaccgaaaccttaaacggaaacccgtgttaaggtacggtaccgtacgacctaacggtacttacgtaccggtttactcccgtaacgttccccg

SEQ ID NO: 102373 - DNA, 758 bp, Homo sapiens
  misc_feature: GYAE6OF01C462R.51.83.H06.1.454.CMB.1.raw
  modified_base (221)..(221): a, c, t, g, unknown or other
  misc_feature (221)..(221): n is a, c, g, or t
  modified_base (715)..(715): a, c, t, g, unknown or other
  misc_feature (715)..(715): n is a, c, g, or t
  modified_base (746)..(746): a, c, t, g, unknown or other
  misc_feature (746)..(746): n is a, c, g, or t
tcagcgatcgtatacacgaccggtgctcgatttagatcacgtgcgtcgcgggggaggaactgctcagttaggacccagagggaaccatggaagccccagctcagccttctcttcctcctgctactctggcctcccagatcgcccaaccggactaaattgtgttagacacagtctccagtcctacccttgttcttttcgtaccgtaccggaagggggaaacnccgacccctaccctctccgtggcgacgggtccagtcaagtaagttataacgagacgtacttacgccgtaggtaccagtaccgaacgaacccgtggacccgacggccctacccgaacggtcccttcctacgtacttacgttaagttcgggacacctacgtaccccgaacggaccgggccctaacgtcggacctacccgttaccccgacggtaccggttaacggtcggaacgggttcggaaccggtaggggttcgggggtacgttacggggaccgtaacggttaccgttccgtaccttcctaacggaccttaagtcccgaacgtaccggaactacggtaagacgtacgtaagttacgttatttacggtattacgttttattaccgtgtacacgtacacggactaaacgtccgtcggtacccgttacggttacggaccgggttaacgaccgtaacgggaactacgggtaactaacgtaaccgtaagtacgtcggacncgttaccgactatccgttagtccttaccgtnttccgttacccg

SEQ ID NO: 102374 - DNA, 704 bp, Homo sapiens
  misc_feature: GYAE6OF01EN602.51.83.H06.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagcgatcgtatacacgaccggtgctcgatttagatcacgtgcgtcgcgggggagaactgctcagttaggacccagagggaccatggaagccccagctcagcttctcttcctcctgctactctggctcccagatggccaccggacaaattgtgttgacacagtctccagttcacccttgtctttgtcctacgaggggaangcccacctctccngcacggccagtcaagagtacttaacagccacttanccgttgaccngcaanaaccgtgccaggccaccgcgctccgtctatcttatggtcgacactcccgaaccgacggggacccacgttcggaccaaccgtccccagacccgtacggttcgacggtggtccgtaggggtgggtacgtacggggtactacggtaccttcgtcgtcttacgacctaacgtcacgtactaacgtaccggtacgacgtccgtaagtaaggttactttttacggacgtttaagtttttactttacgttttacgtacgttaacgacgtaacgtaaccgaaacgttacgtaccgtcccgttaccgttaccggtaaccgggtttccggaaccggtaaacgggacggtaaacgggaacgtaaacgtaaacgtaaacgggtacttaggtacggtacgtacgtaccgaacccgttattcccttagtaaccgtttcctacccggtttacccc

SEQ ID NO: 102375 - DNA, 835 bp, Homo sapiens
  misc_feature: GYAE6OF01AU6Y3.51.83.H06.1.454.CMB.1.raw
tcagcgatcgtatacacgaccggtgctcgatttagatcacgtgcgtcgcggggaggaactgctcagttaggacccagaggaaccatggaagccccagctcagcttctcttcctcctgctactctggcctccagtatcgccgaccggactaaagttcgtgttagacacgtcgtcctccgtacgtccacccgttgttccgtttcgtccgtaccgtaaagggaacgaccgacccctacccgttcgtccgtacgcgacgggtacctagtcgacggtacgttagtacgacgaacgtccgtaacgttacgtcgtacgtaccgacgacgaacgtaaccgtgaccgtacggacctaccgacgtccgtaccgtacgtacgttacgtactaggacgtcaccgtacgtaccgtaacgaccggtacctacggtacgtaccgttaccgtaccgacggtaccgttaacggtacgtacggtcgggtaccgttagggttacgggttacgtaacgggaccgttaaggttaccgttacccgtaaccgttacccgtaaccgtaccgtacgttacgaccggtaaccgtaccgtaccggtacgtaccgttaacggttaacggttacggttaaacgtttagttttaccggtaaacgtttaacggtttaacctttacggtaacgtaccgtaacggttaactacggtttaaacgttaccggtaccggttaccgttacccgttacggtttaaccgttacgggtttaccggaccgggttaacgtaccggtacgtaccgggtacgtaactaccggtaaacgtaccgtacgttcgtacgacgtaacgtcgaacttcggtaccg

SEQ ID NO: 102376 - DNA, 760 bp, Homo sapiens
  misc_feature: GYAE6OF01A51FP.51.83.H06.1.454.CMB.1.raw
  modified_base (219)..(219): a, c, t, g, unknown or other
  misc_feature (219)..(219): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgaccgaccggactaaattgtagttacggaccactagtctccgagtcaccgtgttcgtttctacgtaccgaaggggtaacncgcccctaccctcgtaccgtgcgacggtaccgacgtaccgaggtagttaacctttaacgacggaccggtaacttaccggccgtacggtaaccacgaaccgaaccgaaaccgtcgggaccaacggcccgtacccgacggtccctcctcctattctagtaggggtcactaccaccgaaccggacggcctacgcggacctaccgcccgacggtaccgtaagggtcgtcgtacggtacgtggggttaggtaccggtaggggaactacgggttaccttcccgggtctaccgttaaccgacttaccacgacgacgtactacccgaggtcgtacgtagtaacgtttatttcgttagttagttttactttaggtctagtacgacgtaccgtaacgtaactaccggttcgtccgttaccggtacgggttaccggaccggtaacggtacgggtaacgtacgggtaacgttaaacgaacggtaaacgtacgtaggtcggtaccgacacgtaccgttacttacgttacgttaccttccggtcctttacccccg

SEQ ID NO: 102377 - DNA, 899 bp, Homo sapiens
  misc_feature: GYAE6OF01CHNOE.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggactaaagttgtgttagacactagtcctaccagtccctacccttgttcctttcgtaccgtacccggaaggggaaacgaccgacccctaccccgttcgtccgtcggacggaccgggtccctaaggttaccgtaaaggtaacgttaaacttaaaccggacggtaccgttaaccgttaccggacccgtttacggtacccgaacggtaccgtaaaaccggaaacccgttcgggacccgtaacgggtaccccttaccccggtaccggggtaccccttaacccgttccgtaacgttacccgtttaaggtcgggttaaccgtacccaccgttaacccccgacccgggtaaccggggacccctaccggtacgggaccccttaccggaccccggtaacggtaccgtacgggtttaacgacggggtacgtaccggtaaggggtccgggttacgtaacgggaacctacggtttaaccgtccgtacctcccgttaaccgacctacgtaccggacgaccgtaacggtaccggaacgtacgttacccgttaaggtaaacgtttgtttaccgtaaggtttagttttaacgttacgtacgtacacggtacgaacgtaaccgtaaaccgttcgtaccgttaccgttacggttacgggtacccggttacggaacccggtacggtaacgtaaggtaacgaaaccggtaacgaaacgtaccggtaggtacctagaccgtaccacgtcttacgtacctcctttacgtcttcccg

SEQ ID NO: 102378 - DNA, 736 bp, Homo sapiens
  misc_feature: GYAE6OF01A03XL.51.83.H06.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
tcagcgatcgtatacacgaccggtgctcgatttagatcacgtgcgtcgcgggggaggaactgctcagttaggacccagagggaaccatggaagccccagcctcagcttctcttcctcctgctactctggcctcccagactgccaccggaactaaattgtgttgactacgagtctaccgagtccacccttgtctttgtcctacggaagggaaacgcgccctacccttcctcctgacgnggcagtcagatataacngcgtactagcctaggtaccagcaacgtaaccgtggaccacggccacccgnggtcctcccgtntactctagtggcgtacctactacccacgaccgggtacctcgtacgaccncgttaacccgacgccgttacggtaccgtagggtcggccgtagggtcgggtacgacggggtaactacggttaccgtttcccgcttaccgacctacccgaacgtacacggaccgaacgtccctaagcccgttagtaacgtaatttgtttacgtactttaaggttttattaacgttcgacgaagtacccgaacgttaaacaaccggtttccgtacgttcccgttacgggtttaaccggttaccgggtacccggaaacggtaacggaacccgggtaaaggtaaacgtaaacgtaaaccgtaaaccggtcgtagggtacccggatcccggtacaacggttactacggtttaccttacccttcgtaccgttcccccg

SEQ ID NO: 102379 - DNA, 920 bp, Homo sapiens
  misc_feature: GYAE6OF01ESHVS.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcacccttgttctttgtctaccgaaggggaagacgcctacctcctcctgcgacgggaccagtacaggtaagttaattaaacaggtaccgtacgttacggaccttacggggtaccacgtacaacgggaaaacccgttccggggcccgaacgggcccgttaccccggaacggggtccccttccctaccctaagtttaccttaacgttcgggtcgtacctacgtaccccgaccggtaccgggacccacggtacggaccaccgttaccaccggtaccgtaggttccgacggtcggacggtacgggtcggggttaccggtacggggtaacgacgggttaccttaccggtccctttccgtaccgaaccccttacgtaccgaaccgtacggaacccgttaccgaacggtaccgtaccggttaaggtaacgtttaacgtttacggttacggtttaacgtttttaacgttacgtttacggtacgtacggtaaccgtacggtaaaccggttaaacgacccgggtttacccgggtttacccctttaccgggggtttccgggttaacccggggtttacccgggaaacccggggttaaccgggaaacccgggttaaaaggggtaaaccgggttaaaaaccggtaaccggttaaaaaccgggtccggtttacgggtacccgggtacccggtaacgtaaccccgtaaccgttacctttccggtttaacccgtttactttaccccggtcctttaaccccccggg

SEQ ID NO: 102380 - DNA, 766 bp, Homo sapiens
  misc_feature: GYAE6OF01AOYQF.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctcggcctcccagatcgccgaccgactaattgtgttgacgactacgtccccagtccacccttgttcgtttcgtcgtcggaagggtaaacgcgccctaccgtcctaccgtgacgacgggtcctagtacgaagtagtaataacgagacgtactacgcgtacggaccacgacgaaccgaacgtcggtaccgcgtacccgccgacgccgtacctctacgtacgtagtgtcgacctacgacccgaaccgccggtacctaccggtacggactacctacccgtacggaccgttacggtacggacggtcggtcgttaggggtaccggttagtaccgggaactacggttccgtcggacccttaccgtacaacccgttcgccggtactaccgaccgtacgtacgacgttacgtacgttaagttaccgtttagtacgtttacgtttacgtttgttacggtactacgtaaccgtaacgtaacgaaccgttaccggtacccgttaccgtaccggttccgggtaccgtaccggaaccgggtaaccggtaacggttaccggtaaacgtaaccggtaaccgtaacccgttacggtcggtagaccgttccgaccgttaccgtcgttcttacggttcctacccgttccgttccgtacccg

SEQ ID NO: 102381 - DNA, 886 bp, Homo sapiens
  misc_feature: GYAE6OF01APXW1.51.83.H06.1.454.CMB.1.raw
tcagcgatcgtatacacgaccggtgctcgatttagatcacgtgcgtcgcgggggaggaactgctcagttaggacccagagggaaccatggaacgccccagctcagccttctcttcctcctgctactcgtggcctccagatcgaccaaccggactaagtttgtagttagacctacgtacgttcctaccacgtcctacccgttgttccttttcgcctacgggaaaggggaaactccgccctaccctctccgtcggaccggaccgggacctaggttacaaggtaacgttaacttaaccgcggtacctacgttaccggccgttacggtaaccacgaaccgtaaacggtaacccgtcggacccgtaacggttccccacccggtacgtccccttacctactacgttaccgtaggtcggtccacctacccgtaccccgaaccgggtccggaccctacggtaccgacctacccgtaccccggtacggtacccgttacgggttacgtaccgggggttacggtacgggttacggggttacggggtaccgggtaacgggaaccttccgggttacccttcgtacccttaacccctaccggtaacctacgttccgaaccgccgtaaccggtaccgtaacgaccgttaccgggttaaagttaacgttttacgtttaccgtaaagtttttagttttaacgttcggttacgtacgtaacgtaccgtaacgaaaccgttaacgtccggttacgttcccggtaccgtttcggaccggttaccgggaacgtacgggtaacgtaacggtaactaccgggtaaactaaccgggtacttaggggaccctacgtaaccgaccttaaccgtttcgttaccgttaccttcttaccccgttctaacccccgg

SEQ ID NO: 102382 - DNA, 709 bp, Homo sapiens
  misc_feature: GYAE6OF01BEGX0.51.83.H06.1.454.CMB.1.raw
  modified_base (179)..(179): a, c, t, g, unknown or other
  misc_feature (179)..(179): n is a, c, g, or t
  modified_base (678)..(678): a, c, t, g, unknown or other
  misc_feature (678)..(678): n is a, c, g, or t
tcagcgatcgtatacacgaccggtgctcgatttagatcacgtgcgtcggtcgggggaggaactgctcagttaggacccagagggaaccatggaagccccagctcagcttctcttcctcctgctactctggctcccagatcgccacgggactaaattgtgttgacgacagtctccactcnccctgtctttgtcgtcgagggaacgcgaccaccctctcctgcgagggccaggtcaggtatattacagcatcgctgtaccagcgagaaccgtgaccacggtcctaccgacggtcccttaccacgtacttcctaggtcggtcgtacctacgtaccccggaaccgcggggtccccaaccggtggacctaaccgtcccgacgtaccgttacggttaccaggttcggtacgtacgggtcgggtacgtgggaccttaacgtcgttacgccgttctaccgactacgtaccgacgtactacggcccttaggaccgttctaacggtaagtttacgtttccgtaagttcgttttttaacttcggtttacgaccgttacggaattaccgaccggtaattacccgtacggtcccgttagtaccggggtaacgttcccggtaaggaacccggtacggtaaggtaacgtaaactaaccggaaacgtacggtacgtacggactccggaaccgtntacctcgtttagacgtttcctctttacccgg

SEQ ID NO: 102383 - DNA, 814 bp, Homo sapiens
  misc_feature: GYAE6OF01ALPLO.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctccagatcgccaccggactaagttgtgtgacacagtcctaccagtcctacccttgttcctttcgtccgtaccggaaggggaaacgtccgtaccctacccttctccgtacgccggacgggccctaagtccgtaagtacgttaaacttaacgacggtccgttaaccttaacggccgttacggtaaccacggactaaaccggaaacccgtcggacccgtacggtccctcccggtaacgtcctcctacgtacttacggtacgtggtcgacctacccgtacccgaccggaccggccctaacggtccggtacctaaccgcccgtaacggtccgtaacggttcgaaccggtcggtccggtagggtccggttacggacggtacgtaacgtcgtcggacctctaccgactacgaccgtcgtaccgaccgtaccgtacggtaccgtacgttaacggtacgtttacggtttacgttaacggtttacgtttttaacgttcgttacggtacgtaacgtaccgtaacggtaaccgttaaacgccggtttacgtcccggttacggtttaccggtaccggtaccgtaaccggacggtaacggtaacggtaaccgaaacgttaaccggaaacgttccgtagggtacgtaccgtacgtaccgtaccgttcgtacttaccgttcccttcgtaccgttaccccg

SEQ ID NO: 102384 - DNA, 768 bp, Homo sapiens
  misc_feature: GYAE6OF01BIIA2.51.83.H06.1.454.CMB.1.raw
  modified_base (196)..(196): a, c, t, g, unknown or other
  misc_feature (196)..(196): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaattgtgttgacacagtctccagtcacctgtctttgtctccgagggaancgccaccctcgtccgtgcgaggccagtcagagtataacacgcgtactacgccgtcggtaccagtcaacgtaaccgtggacccacggtccctacccgacggcccttccctactacttccgtacgtcgggttacggacctaaccgtccccgaaccggaccggggtaccctaacggtcggacccgtaaccgttaccccgacggtccccggtaaggtttccgtagggtcggacgtagggttcggggttaccgtagggaacctacggttaccgttcggtaccctccgtaccaaccgtactacgacgtaccgacggtacctaacggtaccgtaccgttaaggtaaacgttacgttttacgtaacgtttaacgtttttattacggtttacgtacgtaacgacgtaacgtaaccgaaacgtacccgttacggtacccttacgggttaccggtaccggttaccggaaccggtaacggaaccggttagggaaccgtaaacgtaaccggtaaacgtacgttacgggacggtccgacgtacccgtacttacgttccgtacgtttcccttcgtaaccgttccccg

SEQ ID NO: 102385 - DNA, 885 bp, Homo sapiens
  misc_feature: GYAE6OF01DA645.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagattcccgaccggaagtaaattgtgttgacacagtctccgaggccaccctgttctttgtctaccgaaggggaaagacgcccaccctctacctgacgacgggccagtcagtagtgttagtcactttctacgccgtagtaaccaacactaaaccgcgaccgtacgccgtacccgacggtcctaccttactaactttagtagtactacgtaccaacgtaaccggaaacgggtacggaccctaacggtccgggtacccggtaccccgaacggtccgtaagggttccgaacgggtcggacgtagggttcgggtcgtacggggtaacctacggttacctaccgtacctacctaccctacctaacgtaccgacgaccgacgtaccgtaaccggtaacgtaccgttaaagggtaacgttttactttaacgttaacgtttaaagttttactaccggtttagaccgtaacggtaccgtaggttacccgtacggttaattaccgggtttccccgaacccgttcccggttaaaccggtaaccctttccccgggttaaacccggttaccggggtaaacccggtaaccgggaacccgttaaacccggggtaacgggaaacggggttaaaaaccttaaaacccggggtttaaaacccgtaaccgggtttaggttaaacccgggttacccgttaaccgaaaaccccgtaccccgttttaaccgttccgtttaccccgtttaacccgtttacccgttaaacccccgg

SEQ ID NO: 102386 - DNA, 1198 bp, Homo sapiens
  misc_feature: GYAE6OF01EARKM.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggactaattgtgttgacacagtctccatccacctgttctttgtctccgaaggggaanacgcctaccctcgtcctcgacgacggcctagtcgtaagtaagtaacttaaccgacggtaccgtaacttacggacccgttacggtaaccgacggtaaccgaaaccggtaaaacccggttcgggaccccgtaaccgggtccccgtaacccgtaccggggtacccttaccccttaccgtaaccgttaccgtttaaggttaccgggtaccgtaccgtaacccgtaccccggtaacccgggaaccgggggtaccccgttaacggtacccgggtaccctaaccccgttaaccccgggtaaccggttaacccgggtttaacgggtttacccggtacgggggtttacgggaacccgggtttaagggggttccgggggttaccgggtacgggggtaaaccccgtaaacgggtttcccgtttacccggtaaccccgttaccgtttaaaccccgaaaccccggttaccgttaaacccggtacccgggtaaacccggttaacccgggtaaaccccggttaaaccggggttaaccgggtttaaacccggttaaaacgggttttaaacggtttacgggttttttaaacggttaaacccgttttttaaagggttttttaaacgttttttaacccggttaaccgggttaacccggtaaacccgggtttaaaccgtaaacccggggtttaaaaccccgtaaaaccccgggtttaaacccggggtttaccccggtttaaccccggggtttttaaccccgggtttaacccggggttaaacccgggggttttaacccccgggggaaaccccgggtttaaaaccggggggtaaaccccgggttaaaaacggggttaaaaccgggttaaaaacccgggtaaaacccggttaaaacccggggtttaacgggttttacccgggtaacccgggtttaacccggaccccggtttaaaccccgttaacccggttttaaccgttaaccccggttttaacccggttttaaccctttaccccggtttaa

SEQ ID NO: 102387 - DNA, 300 bp, Homo sapiens
  misc_feature: GYAE6OF01CFUCJ.51.83.H06.1.454.CMB.1.raw
  modified_base (137)..(137): a, c, t, g, unknown or other
  misc_feature (137)..(137): n is a, c, g, or t
  modified_base (150)..(150): a, c, t, g, unknown or other
  misc_feature (150)..(150): n is a, c, g, or t
  modified_base (168)..(168): a, c, t, g, unknown or other
  misc_feature (168)..(168): n is a, c, g, or t
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (244)..(300): a, c, t, g, unknown or other
  misc_feature (244)..(300): n is a, c, g, or t
tcagcgatcgtatacacgaccggtgctcgatttagatcacgtgcgtcgcgggggaggaactgctcagttaggacccagagggaaccatggaacgccccagctcagcttcctcttcctcctgctactctggctccagntcgccaaccgganaaatttggtgttgacacngtcctcatcacccttgtctttncgtacaggggaacncgccccacccttcgtcctggacgacgggtccacggtacgnnnnnnnnnnnnnnnnnnnnnnnnnnnnnnnnnnnnnnnnnnnnnnnnnnnnnnnnn

SEQ ID NO: 102388 - DNA, 897 bp, Homo sapiens
  misc_feature: GYAE6OF01CGHIC.51.83.H06.1.454.CMB.1.raw
  modified_base (849)..(849): a, c, t, g, unknown or other
  misc_feature (849)..(849): n is a, c, g, or t
tcagcgatcgtatacacgaccggtgctcgatttagatcacgtgcgtcgcgggggaggaactgctcagttaggacccagagggaaccatggaacgccccagctcagcttctcttcctcctgctactctcggcctcccagatcgaccaaccggaataaattgtgttacgacacacgtcctaccactccacccgttgttctttgtccgtacggaaggggaagaccgcccctacccgtacctcccgtcggaccgacgggaccctagtacgtaagtaacgttaacttaaccgacggtaccgtaacgttaccgtacccggttacggtaacccgacgtaaccgaaacgtaacccgggtaccggacccgaaccgggtcccctacccggtaaccggtcccttaaccccaccgttactttaaccgtaggttccggggtacgacctacctaccccggaacggaccgggtacccgtacgtcgggaaccccttaccgaccccggtaccgtacggtacgttacgtacggtacgggtaccggttacggggtccggggtacggtaacgggtaaccgtacgtttaccccggtaccgtccctacgtactaaccccgtagtacgaacgtcccgaacgtacccggtacgaaccgttaccgtaaggttaacgtttacgggtttaacttcgtttaaacttttaggttacttaccggtaagtacccggtacggtaaccgtaaccgtaaccgttccggtaccggttcccgttaccggttacgggtacccggttaccgggtaaaccgggacgggttaaaccggtaacggtaaaccggaaaccgtaaacgtaacgggtaaccgtggtacggtacnccgtaattacccgtacgttacttacccttcgtaccctttcgtaccccg

SEQ ID NO: 102389 - DNA, 686 bp, Homo sapiens
  misc_feature: GYAE6OF01ADS1K.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaacgtgctcagttaggacccagagggaaccatggaagccccagctcagcttctcttcctcctgcctactcgtgctccagatcgccacggacaattgtgttgacacgagtctccagtccacctgtctttgctccgagggaaancgcccaccctctctgcgacggcctagtcaagactatacgacgcgtatacgccgtaggtaccagactaacgaaccgtggaccgagtccctacccgaggccttaccgcttagtaacgtgttacggtccaccgtacacccgtaccggacgggtccacggttacgcgacccttaccggaaccggcttaacgggtctacggacggcgtaacggggttcggttccggaggtacccgtaacggccctttaggactccgttaacaccgactcgaccgacaccgttaccacggtatacccgttagtacttacgttagtaacctttacttacgttaccgtagtaccgtattaaccgtaattaccgttaagtaccgttacgtaacccttcgttaaccgttacggttcgaacgggtaccgtacgtacgtgtacgtaacgtaccgtaaccggtaactcggtacggtcgtagtacctacacgttatcctgtttccgtaccg

SEQ ID NO: 102390 - DNA, 730 bp, Homo sapiens
  misc_feature: GYAE6OF01AYPPF.51.83.H06.1.454.CMB.1.raw
  modified_base (264)..(264): a, c, t, g, unknown or other
  misc_feature (264)..(264): n is a, c, g, or t
tcagcgatcgtatacacgaccggtgctcgatttagatcacgtgcgtcgcgggggagaactgctcagttaggacccagagggaaccatggaagccccagctcagcttctcttcctcctgctactctggcctcccgagactcgacccgaacggaactaaattgtgttagacactgtctccgacgtccaccgttgttctttgtcctaccggaaggggaagccgccctacccgttctcctcgcgacggccacgtcagtagtactaacncgtacgtactacgccgtaggaccagactaacgtaaccgtcggaccctacggcctacccgaggtccttacctacctactaccgttaggtacggtcctacctaccgtaccccgaaccggtacgggaccctacggttacgaccctaaccgtacccgacggtaccgttaggttacgacgggtacgtacggttacggggttcggtacggtacgggactacggtacccttcgaccttacaccgtaacctacgtacgacgtacgtacgacgtacggacgttacgtaagttaacgttcgtttacgtattttacgtttagttactggtacgtacgtacgaacgtaacgtaaccgtcgttaccgtacccgtacgttacggtaccggtacggtaaccgaacggtacgtaaggtaacacggtaactacgtacggtagtacgtcaccgtactcgttactcgttctactcttcgtacccc

SEQ ID NO: 102391 - DNA, 709 bp, Homo sapiens
  misc_feature: GYAE6OF01C48B7.51.83.H06.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (412)..(412): a, c, t, g, unknown or other
  misc_feature (412)..(412): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggactaaattgtgttagacactagtctccagtccacccttgttctttgtcctcgaagggaancgcccaccctcnccgtgcgacggcagtcagatataacngctactcgctcggtaccagacagaaccgtggccacggcctacccgagtcctcctcatcctagtcggtcacactcccgaccggacgggcccagtcggacctaccgtcccgacgccgttacggtcgaggtcggcgtggtcgggtcggtggactacggtcttccgcttccnccaccactcgagacaccgccgtacgacgtacctagtaacgtttacgtttgaccttttaagtttacgtttacttcggtaccgtaacggtacgtaaccgtaaccggtaaaccgttaccggttacccggttccccgtttaaccgggttgggttaaccccgggttacgggaacccgggtaacgggaaccgtaaagggtaaaccgaaactaaccggtaaaccggtaacgttcggtaacggtcccgtaacgtacccgtactaccgttaccttacggtttaacccttgttcccctttacccccg

SEQ ID NO: 102392 - DNA, 667 bp, Homo sapiens
  misc_feature: GYAE6OF01APL44.51.83.H06.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (355)..(355): a, c, t, g, unknown or other
  misc_feature (355)..(355): n is a, c, g, or t
  modified_base (459)..(459): a, c, t, g, unknown or other
  misc_feature (459)..(459): n is a, c, g, or t
  modified_base (493)..(493): a, c, t, g, unknown or other
  misc_feature (493)..(493): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccacccttgtctttgctccgaggggaaancgccctacctctcctgcgagggccagtcagtagtacttaacgngtaccgtacttagcccgtagggtaccaaggtaccaaacggtaaaccgtcgggacccaacgggcccttaccccgaggtcccttacctcgtaattccgttagttcgggttacncctacctacccgaaccgtcggggacccagtcggcaaccgtccgacgtccgtaggttccaggttcgcgtacggtcgggcgtagggactgtacctcgctcctcacntcgagacgacgaccgtagacgtcgtagaagtttnttcgtacttagttttacttgtacgactacgtcgaagtaaccgaagtaccgtcgtaccgttaccgtacgggtccgttaccggaacgacggaacggtaaggtacggaaaactacgaaacggtcgtagacggtcaccggtaccacgttacttccgtatttccgtcgtccgttacccg

SEQ ID NO: 102393 - DNA, 495 bp, Homo sapiens
  misc_feature: GYAE6OF02ILZII.51.83.H06.1.454.CMB.1.raw
tcagcgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctagccaggctcccaggctctcatctatggtgcatccaccagggccactggcatcccagccaggttcagtgcagtgggtctgggacagacttcgctctcaccatcagcagcctagagcctgaagatttgctagtttattattgtcagcagcgaaacaactggcctcttggacttcggccaaggaccaaggtggaatcaaacgaactgtggactgacacatctgtcttcatcc

SEQ ID NO: 102394 - DNA, 496 bp, Homo sapiens
  misc_feature: GYAE6OF02I718N.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctccaggctcctcatctatggtgcatccaccagggccactggcatcccagccaggttcagtgcagtgggtctgggacagacttcgctctcaccatcagcagcctagagcctgaagtatttgctagtttattattgtcagcagcgaaacactggcctcgttggacgttcgccgaaggaccaaggtgaatacgaacgactagtggctgcacatctgtcttcatcc

SEQ ID NO: 102395 - DNA, 507 bp, Homo sapiens
  misc_feature: GYAE6OF02IOUJY.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagtatttgctagtttattattgtctagcagcgaaacaactggcctcttggacgttcgaccaagggaccaaggtggaatacaaacggaactgtaggctgcaccatctgtcttcattcccg

SEQ ID NO: 102396 - DNA, 506 bp, Homo sapiens
  misc_feature: GYAE6OF02GOIKZ.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctccaggctcctcatctatggtgcatccaccagggccactggcatcccagccaggttcagtggcagtgggtctgggacagacttcgctctcaccatcagcagcctagagcctgaagatttgctagtttattattgtcagcagcgaaacactggcctccgttggacgtttcggccgaagggaccaaggtaggaatcgaaacgaactagtggctgcaccatcctgtcttcattcc

SEQ ID NO: 102397 - DNA, 499 bp, Homo sapiens
  misc_feature: GYAE6OF02F9R2P.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagtatttgctagtttattattgtcagcagacgaaacactggcctcgttggacgttcggccaaggaccaaggtgaatacgaacgaactgtggctgcacatctgtcttcatcc

SEQ ID NO: 102398 - DNA, 482 bp, Homo sapiens
  misc_feature: GYAE6OF02G5ZH6.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagataccactggagaagtagtgatgacgcagtctccagccaccctgtctgtgtctccaggggaaagagccaccctctcctgcagggccagtcagagtgtagcagcgacttagcctggtaccagcagaaacctggccaggctcccaggctcctcatctatgatgcatccacaagggccactgatatccagccaggttcagtggcagtgggtctgggacagagttcactctcaccatcagcagcctgcagtctgaatattttgctaatttattactgtcagacagtataatactgcctcgtacactttgccagggaccaagctggagagtacaacgactgtggctgctacg

SEQ ID NO: 102399 - DNA, 533 bp, Homo sapiens
  misc_feature: GYAE6OF02I1EK2.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagccaccctctcctgcagggccagtcagagtattaacagcgacttagcctggtaccagcagaaacctggccaggctcccaggctcctcatctatggtgcatccaccagggccactggcatcccagccaggttcagtgcagtgggtctgggacagacttcgctctcaccatcagcagcctagagcctgaagtattttgctagtttattattgtcagcagcgaaacaacgtgccttccttggtaccgttcgggaccgaaacgggtaccgaagggtaggaacgtacgaaaccggtaactggtacggctagaccaccagtccgtgtcttcacgttcccg

SEQ ID NO: 102400 - DNA, 504 bp, Homo sapiens
  misc_feature: GYAE6OF02G2629.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatcccaccgagggccactggcatcccagccaggttcagtggcagtgggtctgggacagacttcgctctcaccatcagcagcctagagcctgaagtatttgctagtttattattgtcagcagcgaaacacgtggcctcgttggacgttcggaccgaacggaccaaggtgaatcgaaacgactgtgctgacacatctgtcttcatccg

SEQ ID NO: 102401 - DNA, 551 bp, Homo sapiens
  misc_feature: GYAE6OF02IJO7Z.51.83.H06.1.454.CMB.1.raw
  modified_base (198)..(198): a, c, t, g, unknown or other
  misc_feature (198)..(198): n is a, c, g, or t
  modified_base (389)..(389): a, c, t, g, unknown or other
  misc_feature (389)..(389): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtattaacagcgacttagcctggtaccagcagaaacctggccaggctccaggctcctcatctatggtgcatccaccagggccactggcatcccagccaggttcagtggcagtgggctgggacagacttcgctctcaccatcagcagcctagcgcctagaagtntttgctagtttattatttgtacagcagacgaaacacgtcggcctccgttggacgttcgggaccaaaggggaacccaagggtaggaaacgtacgaaaaccggaacgttacggtacggtcctacggacctaccgtattccgtacgttacctttaccattccccg

SEQ ID NO: 102402 - DNA, 641 bp, Homo sapiens
  misc_feature: GYAE6OF02H2I9X.51.83.H06.1.454.CMB.1.raw
  modified_base (313)..(313): a, c, t, g, unknown or other
  misc_feature (313)..(313): n is a, c, g, or t
tcagcgatcgtatacacgaccggtgctcgatttagatcacgtgcggtcggcgggggaggaactgctcagttacggacccagagggaaccatggtaagcccctagctcagcttctcttcctcctgctactctggctccagatgccaccggacaaatttgtgttgacactaagtctccagtcaccctgtctttgtctccgaggggaaagacgccgaccctctccgtggcggagggccagtcagagtattaacagcgacttagctggtaccagcagaactggccaggctacccgaggcctcctcatctagtgggtncacgtccgaccgacgggccacgttcggcaactcccgaggccagggttccaggtcggctaggtgggtctaggggaccacgtacgttcggccttctaccacctatcgaacgacagtacctaagacgccgtagtaagtatttcgacttagtttaattagtttgtacacgtacgagaccgaaacaaccgtcggtacccgttccgttacggtaccgtttcggaccggtaaacgggtaaccgtaagggtacgaacgttaccgaaacggtaacggtacggtacggtacgttacgacccgtacgtacgtccgtacggttccttaccgtacttcccg

SEQ ID NO: 102403 - DNA, 573 bp, Homo sapiens
  misc_feature: GYAE6OF02J28C5.51.83.H06.1.454.CMB.1.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacngcgacttagcctggtaccagcagaaacctggccaggctcccaggcctcctcatctatggtncatccaccgagggcccatcggcactccccagccctaggttccaggtggcaggtgggtctgggacnggacttcgctctcaccatcagcacgcctagacgcctagaagtactttgacttagtttattacgttgtcagtcaggtaccgaaactacgcggtaccctcgttacgggacgttccggaccgtaagggaccaagggttacggaaactcgaaaaccggtaacgttggtacggacctacggaccaccacgtcttcggttaccttacgacttcccg

SEQ ID NO: 102404 - DNA, 530 bp, Homo sapiens
  misc_feature: GYAE6OF02F70V3.51.83.H06.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagattccaccggagaaattgtgttgacacagtctccaggcaccctgtctttgtctccaggggaanagccaccctctcctgcagggccagtcagagtgttagtcacttcttagcctggtaccaacacaaacctggccaggctcccaggctcctcatttangatgcatccaagagggccactggcgtcccagccaggttcagtggcagtggtctgggacagacttcactctcaccatcagcagcctagacgcctagaagtatttgactaatttatactgtcagctagcgtagctaattcggcctccctcgtactccgaccttcggaccaagggaccacgactggaacgaacgtaaacgaacttcggtaggtctggaccacgacttcgtgttccttatac

SEQ ID NO: 102405 - DNA, 491 bp, Homo sapiens
  misc_feature: GYAE6OF02HLM27.51.83.H06.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagcgatcgtatacacgaccggtgctcgatttagatcacgtgcgtcgcggggaggaactgctccagttaggacccagagggaaccatggaagccccaggctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaacctggccaggctccaggctcctnatcatggtgcatccacagggccactgcatcccagccaggtcagtggcagtggctgggacagacttcgctctcaccatccagcagcctagacgcctgaacgatttgctagtttattattgtcagcancaanactgcctctgacgttcgcaaggaccaaggtgaatcaaacgactagtggactgactaccatcctgtacttctatcc

SEQ ID NO: 102406 - DNA, 780 bp, Homo sapiens
  misc_feature: GYAE6OF02JISO4.51.83.H06.1.454.CMB.1.raw
tcagcgatcgtatacacgaccggtgctcgatttagatcacgtgcgtcgggcgggggaggaacgtgctcagttagggacccagagggaaccatggaagccccagcgtccagctcgtcttcctccgtgcctactctggctccgagactggccaccggacaaattgtgttgacaccagtctccacgtcaccctcgtctttcgtcctccgacggggaaacgacgtccctacccgttcgtccgtacgacgagggcccaaggttccaagtacgtaacttaacgacggcgaacgttacgaccgtagggtacccaagtacgaacggtaaaaccgttaggtaccgtaaggcctaacccgaagggaaccctaccggtaaccacctacgtaaacgtcgggttacgactactacccgtaaccggtacgggaccctaaccgtcgggtcacgttcccgaggtcccggtaaccggttcgtaacggtacgggtaccgaagggttcggggtacgtaggggtacgaacggtaccgtttcgggacctacgttacctacccgtaacttccgaacgacctaacggtccctaaggacggtcccttaggaaacgttacgtttcgaccgtaagttttatttacgtcgtacctacggtctaacggtaccaaacgtacgttcggttaccctacgtttcggaccgtttccggtaccggaacggtaccgaaggttaggaacttcgaaacgtaccgttaggaacggtcttggaccgacgttacgtccttacggtccttacacgttcccg

SEQ ID NO: 102407 - DNA, 543 bp, Homo sapiens
  misc_feature: GYAE6OF02JZDA0.51.83.H06.1.454.CMB.1.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctccaggctcctcatctatggngcatccacngggccacgtgcatcccagccaggttcagtggcaggtggtctgggacagtacttcgctctcacatcagcagcctagacgcctagaagtatttgctagtttattattgtactagctagaccgtaaactacgtcgccttaccgtggaccgtttacggaccaaagggacctaagggtacgaactacgaaacggtacgtaggtacggactacgaccgaccgtagtctacgtcttacgacttcccg

SEQ ID NO: 102408 - DNA, 531 bp, Homo sapiens
  misc_feature: GYAE6OF02G8TKJ.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagcttcgctctcacatcagcagcctagacgcctagaagtatttgctagtttattattgtacagcagacgaaacacgtcgcctccgttggacgttccggaccgaaagggacctaagggtacggaatacgaaacggtaactaggtacggctacgacacctactccgtgtccttcattcccg

SEQ ID NO: 102409 - DNA, 507 bp, Homo sapiens
  misc_feature: GYAE6OF02FH4YD.51.83.H06.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagccaccctctcctgcagggccagtcagagtattaacngcgacttagcctggtaccagcagaaacctggccaggctcccaggctcctcatctatggtncatccacaggccactggcatcccagccaggttcagtggcagtggtctgggacagacttcgctctcaccatcagcagcctagagcctgaagtattttcgctagttttattattgtcagcagcgaaacactggcctccgttggacgttcggccaagggaccaaggtaggaatcaaacgaactgtaggctagcacatcctgtcttctattcccg

SEQ ID NO: 102410 - DNA, 571 bp, Homo sapiens
  misc_feature: GYAE6OF02FGYIY.51.83.H06.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgcctactctggctcccagatgccaccggacaaattgtgttgacacagtctccagtcaccctgtctttgtctccaggggaaangccaccctcgtccctgcagggccagtcagtagtattaacagcgacttagcctggtaccagcagaaacctggccaggctacccaggctcctcactcctatcggtncatccacgagggccacgtggcactcccagcccaggttccagttcggcaggtcgggtctggggacaggaccttcgctcgtcaccatcagcagcctagacgcctgaagtatttgctagtttattattgtctagcagacgaaacacgtggtcctccgttggaccgtttcggacccgaaagggtaccgtaagggtacggtaacgtacgaaacggtaacgtaggtacggtcctacgaccgaccgacgtaccgtagtccttacgtacttcccg

SEQ ID NO: 102411 - DNA, 495 bp, Homo sapiens
  misc_feature: GYAE6OF02GGG0V.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggctcctcatctatggtgcatccacagggccactggcatcccagccaggttcagtgcagtgggtctgggacagacttcgctctcaccatcagcagcctagagcctgaagtatttgactagtttattactgtcagcagcgtaacaactgctctcgtttcggcggaggacgaaggtgagatacgaaacgaactgtggctgcacatctgtcttcattcc

SEQ ID NO: 102412 - DNA, 528 bp, Homo sapiens
  misc_feature: GYAE6OF02I3O45.51.83.H06.1.454.CMB.1.raw
  modified_base (198)..(198): a, c, t, g, unknown or other
  misc_feature (198)..(198): n is a, c, g, or t
  modified_base (356)..(356): a, c, t, g, unknown or other
  misc_feature (356)..(356): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagccaccctctcctgcagggccagtcagagtattaacagcgacttagcctggtaccagcagaaacctggccaggctccaggcctcctcatctatggtgcatccaccagggccacgtggccactcccagccaggttcagtggcaggtgggtctgggacngacttcgctctcaccatcagcagcctagacgctgagtatttgctagtttattattgtacagcagacgaacacgtacgtcctccgttggacgttcggaccgaacgggacaagggtaggaactacgaaacggtaactaggtggactacgcaccatcgtgtcttacgacttcccg

SEQ ID NO: 102413 - DNA, 496 bp, Homo sapiens
  misc_feature: GYAE6OF02G45B1.51.83.H06.1.454.CMB.1.raw
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacaggacttcgctctcaccatcagcagcctagagcctgaagatttgctagtttattattgtcagcagcgaaacactggcctcgttggcgttcggccaagggaccaggtgaatcaacgtactgtgctgcaccntctgtcttnatccg

SEQ ID NO: 102414 - DNA, 660 bp, Homo sapiens
  misc_feature: GYAE6OF02FFXG8.51.83.H06.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaatttgtgttgacacagtctccagtcaccctgtctttgtctaccgaggggaaancgccacctctcctgcgagggccagtcagagtataacngcgacttagcctggtaccagcagaaacctggccaggctcccaggctcctcatctatggtcncatccacagggccacgtcgcactcccagcccgtaggttcaggtcggctaggtcgggtcgtggggaccaggtacctcgctcctacgacctatcgacgacacgccgtagacgaccttaggaacgttacgttttacggaccttaagttttacttagttcgttacgacgtactaacgaaccggtaaaactaccgttcggttaccccgttaccggtttacggaacccgggttttccgggaacccgtaaaggggtaacccgtaaaggggtaacgtaactaaccgaaaacggttaaccgtgggtaccgacgttacgaacccgtaaccgtattcccgttaggtttacccttaccgtacctttaccccg

SEQ ID NO: 102415 - DNA, 533 bp, Homo sapiens
  misc_feature: GYAE6OF02JGOAU.51.83.H06.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctntcctgcagggccagtcagagtattaacngcgacttagcctggtaccagcagaaacctggccaggctcccaggcctcctcatctatggtgcatccaccagggccactggcatcccagccaggttcagtggcaggtgggctgggacagacttcgctctcaccatcagcagctagcgcctgaagtatttgctagtttattattgtcagcagacgaacaacgtcggcctcgttcggtacgttcggaccgaacgggaccaagggtacggaatacgaacgtaacgtagtggtaccgtgacaccgtactcgttacgtcttactacttcccg

SEQ ID NO: 102416 - DNA, 663 bp, Homo sapiens
  misc_feature: GYAE6OF02HEB84.51.83.H06.1.454.CMB.1.raw
tcagcgatcgtatacacgaccggtgctcgatttagatcacgtgcgtcgcgggggaggaactgctcagttaggacccagagggaaccatggaacgccccagctcagcttctcttcctcctgctactctggcctcccagatgccaccggacaaattgtgttgacacagtcctccagtccaccctgtctttgtctccgagggggaaagcgcccaccctctcctggaacgggccagtcagagtattaacagcgacttagcctggtaccagcaacgaaacctggccaggcctccgaggcctcctcatctatggtcgcactcccaaccgacggggcccacgtcggaccactccccgagcccgtaggtttccaggtggcgtagggttcggggtctggggacaggtacttcggctctccacatccagcacgtcctaggacgtccgtaggaaagttagttttcgaccttaaggttttattagtttcgtactaggcaaggtaccgaaactacgtcggacccttccgttacggtaccggtttccggaaccgaaacgggaaccgtaaaggggtacggaaactaccgaaaacggtaacgttacgggtacggtaccgtacggaccctaacccgtacgtttccgtacgttccgtttacctacgttccccttaccccgg

SEQ ID NO: 102417 - DNA, 554 bp, Homo sapiens
  misc_feature: GYAE6OF02FFZUZ.51.83.H06.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagataccactggagaagtagtgatgacgcagtctccagccaccctgtctgtgtctccaggggaaangccaccctctcctgcgagggccagtcagagtgttagcagcgacttagcctggtaccagcagaacctggccaggctccgaggctccncatctatgatgcatccacaagggccactgactactcccgagcctaggttcaggttcggcaggtcgggtctaggggacaggtacgtttcactccgtacaccgatcacgacacgcctgctacgtctagtaacgtatttgacttaatttattactgtactagactagtaataacttacgttcggtaccttaccgttactacgtttcggaccgacgggtacctaaggcgtaggacgtactacgaacgtacgtacggtagcgtacgctaaccg

SEQ ID NO: 102418 - DNA, 615 bp, Homo sapiens
  misc_feature: GYAE6OF02J2U7X.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaanagccaccctctcctgcagggccagtcagagtattaacagcgacttagcctggtaccagcagaacctggccaggctcccaggctcctcatctatggtcgcactccaccgacgggcccacgtcggaccagtccccaaggcccctagggttccaggtcggactaggtgggtctggggacacggacctttcggcttacctcaccatcagcacgcctagacgtcctagtaacgtattttcgacttagtttattattcgtacacgtacgaagaccgtaaacaacgtcggtaccttaccgttagggtaccgttaccggaccgtaaacgggaacccgtaagggtacgaacgtacgaaaccggtaacgtcggtacggtacctacggacctaaccgtattacccgtgttaccttcgactttacccg

SEQ ID NO: 102419 - DNA, 560 bp, Homo sapiens
  misc_feature: GYAE6OF02H02OF.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgcccaccggacaaattgtgttgacacagtctccagtcaccctgtctttgtctccaggggaaagagccaccctctcctgcagggccagtcagagtattaacagcgacttagcctggtaccagcagaacctggccaggcctccaggctcctcattctatggtgcactccaccgagggccacgtggccacgtcccagccaggttcaggtcggcaggtgggtctgggacagtacttcgctctcaccatcgagcagcctagcgtcctagaagtatttgacttagtttattattgtcagtacagacgaaacactggtacctcgttacggtaccgttcggaccgaaacgggaccgtaagggtacgaaagtacgaaacggtaacgtcggtacggaccttagaccacgtacgtccttcgtaccttcattccg

SEQ ID NO: 102420 - DNA, 582 bp, Homo sapiens
  misc_feature: GYAE6OF02JC2NL.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaagagccaccctctcctgcagggccagtcagagtattaacagcgacttagcctggtaccagcagaaacctggccaggcctccaggctcctcatctatggtgcatccaccgaggccacgtggcactcccgagcctaggttccagtcggcaggtgggtctggggacaggacttcgctctccgaccatcgacgcacgcctagacgcctagaagtacgtttgacttagtttattagtttcgtacgacgtcgtaacgaccgaaactacgtacggtaccttacgttacggtacgttccgggaccgtaacgggtaaccgtaagggtacgtaacgtacgaaacgtaacgtaggtacggtacgtcgacgacgtacgtcctgtcttcgtacttcccg

SEQ ID NO: 102421 - DNA, 541 bp, Homo sapiens
  misc_feature: GYAE6OF02IZTJB.51.83.H06.1.454.CMB.1.raw
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagcccaccctctcctgcagggccagtcagagtattaacagcgacttagcctggtaccagcagaaacctggccaggcctccaggctcctcatctatggtncatccacagggccacgtggcatcccagccaggttcagtggcagtgggtcngggacagacttcgctctcaccatcagcacgcctagacgcctgaatatttcgactagtttattattgtcagtcaagtacaaacgactcggtccctacgttcggaccgttcggaccgtaaagggaccgaaggttacggaaatcgaaacggtaactggtcggactcgaccaccgtatacctggtcttcacttcccg

SEQ ID NO: 102422 - DNA, 708 bp, Homo sapiens
  misc_feature: GYAE6OF02GT7E5.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagngccaccctctcctgcagggccagtcagagtataacagcgacttagcctggtaccagcagaaacctggccaggctccaggctcctcatctatggtgctatccacgagggcccacgtggccactcccgagccgtagttccaggtcggactagggtcgggtcgtacgggaacacggtaccgttcggaccttccgtaccaaccctagtccgagccacggtaccctaaggacgtcccgtaaggtaaacgtttagttttacggacgtttaagtttttaatttacgttttggtaccgtacggtaccgtaaacggtaaccggtaaaacttaaccgtacggggttacccctttaccggtttacggggtaaccgtttccgggaaacccggtaaaccggggtaaaccgtaaggggtacggtaaaacgttaccggaaaaccggttaacggttaggtacgggtccgtaacgaccgtaacgtacttccggttagtttccctttaccgtaccgtttacccccg

SEQ ID NO: 102423 - DNA, 578 bp, Homo sapiens
  misc_feature: GYAE6OF02G8I0N.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccatgggaaanagccaccctctcctgcagggccagtcagagtattaacagcgacttagcctggtaccagcagaaacctggccaggctcccaggctcctcatctatggtgcatccaccagggccactggcactcccagcctaggtcagtggcaggtgggtctgggacagacttcgctctcaccatcagcacgcctagacgcctagaagtagttttgacttagttttacttatttcgtctagtcagaccgaaactaacgttcggaccttccgttacggtaccgttcggaccgtaaagggacctaagggtacggaaataccggaaaacgtaacggtacggtacgggaccgttcggacctaaccgtacgtaccttacgttcgtttacctacccg

SEQ ID NO: 102424 - DNA, 518 bp, Homo sapiens
  misc_feature: GYAE6OF02GIGP1.51.83.H06.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacngcgacttagcctggtaccagcagaaacctggccaggctccaggctcctcatctatggtncatccaccagggccactggcactcccagccaggttcagtggcaggtggtctgggacaggacttcgctcncaccatcancagcctagacgcctgaagtatttgctagtttattattgtcagacagacgaaacacgtgccttcgttggacgttcgcgaacggaacaggtaggaactcgaaacgaacgtagtggactcgaccactacgtctgtacttcacttcccg

SEQ ID NO: 102425 - DNA, 560 bp, Homo sapiens
  misc_feature: GYAE6OF02JATFK.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggcctccaggcctcctcatctatggtcgcactcccaccgagggccacgtggccactccccgaggcccaaggttccaggttggcctaggtcgggtctaggggacaggtacttcgctctcaccatcagcagcctagacgcctagaagtatttgacttagtttattattgtactagctagacgaaacacgtcgtcctaccgttcggtaccgttcggaccgaacgggaccaagggtacgaactacgaaacgtacgtacgtggtactcgactacactctcgtcttcgacttcccg

SEQ ID NO: 102426 - DNA, 551 bp, Homo sapiens
  misc_feature: GYAE6OF02GHV3O.51.83.H06.1.454.CMB.1.raw
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (430)..(430): a, c, t, g, unknown or other
  misc_feature (430)..(430): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagcgccaccctctcctgccagggccagtcagagtataacagcgacttagcctggtaccagcagaacctggccaggcctccaggctcctcatctatggtncatcccacgaggccatcggcagtccccagccaggttcagtcggcaggtggtctgggacngacttcgctctcaccgatcagcagcctagcgctagaacgtatttgctagtttattagtgtctagcagtacaaanactcggtcctcgtggacgttcgggaccaacgggaccgtaaggacggtaatacgaaacggtaactacggttcggacgtacgaccgtaaccacgttaccgcgtttacttacgtaccttacccg

SEQ ID NO: 102427 - DNA, 528 bp, Homo sapiens
  misc_feature: GYAE6OF02JD2U3.51.83.H06.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (395)..(395): a, c, t, g, unknown or other
  misc_feature (395)..(395): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtattaacagcgacttagcctggtaccagcagaacctggccaggctcccagctcctcatctatggtncatccaccagggccacgtggcactcccagccaggttcagtggcaggtgggtctgggacaggtacttcggctcgtcaccatcagcagcctagacgctgaagtntttgctagtttattattgtacagtcagacgaaactacgtcgcctacgttcggtacgttcgaccgaacgggacagggtagaactacgaaacgtacgtagtcggactcgacactactactgtcttactattcccg

SEQ ID NO: 102428 - DNA, 507 bp, Homo sapiens
  misc_feature: GYAE6OF02F5EMH.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactgcgggatcccagccaggttcagtggcagtgggtctgggacagacttcgctctcaccatcagcagcctagagcctgaagatttgctagtttattattgtctagcagcgaaacaactggcctccttggacgttcggccaaggaccaaggtggaatcgaaacgaactagtggctgcaccatctgtcttcattcccg

SEQ ID NO: 102429 - DNA, 568 bp, Homo sapiens
  misc_feature: GYAE6OF02FZWBA.51.83.H06.1.454.CMB.1.raw
tcagcgatcgtatacacgaccggtgctcgatttagatcacgtgcgtcgcgggggagggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccagctccagctctcatctatggtgcatccaccagggccactggcatcccagccaggttcagtggcaggtggtctgggacagacttcgctctcacatcagcagcctagacgcctagaacgtatttagcgtagttttattacttgttccagacgtagaccgaaacaaacgtggcccttccgttggaccgtttcggaccgaaacgggtaaccgaacgggtacggaacgtaactaaacggtaaactaggtacggacgttacggactaacccgattaccgtagtaccgtttactacttacccg

SEQ ID NO: 102430 - DNA, 569 bp, Homo sapiens
  misc_feature: GYAE6OF02FQC2X.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctcctcatctatggtgcatccaccagggccactggcatcccagccaggttcagtggcaggtgggtctgggacagtacttcgctctcaccatcagcagcctagacgcctagaagtatttcgctagtttattattgtcagcagacgaaacaacgtcggtaccttccgttcggaccgtttcggaccgtaaacgggaaccgtaagggtacggaaactaccgaaaacggtaacgttaggtacggctacggacctaccgtacgttccgttacgttacctttacctagttaccccg

SEQ ID NO: 102431 - DNA, 537 bp, Homo sapiens
  misc_feature: GYAE6OF02FOSER.51.83.H06.1.454.CMB.1.raw
  modified_base (199)..(199): a, c, t, g, unknown or other
  misc_feature (199)..(199): n is a, c, g, or t
  modified_base (370)..(370): a, c, t, g, unknown or other
  misc_feature (370)..(370): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccacctctcctgcagggccagtcagagtataacagcgacttagcctggtaccagcagaaacctggccaggctcccaggctcctcatctatggtgcatccaccagggccacgtggcactcccagccaggttcagtggcaggtgggtctgggacagacttcgctctcaccntcagcagcctagacgccgtagaagtatttgactagttttattattgtcagcagacgaaacactcggtcctccgttggacgttcggaccgtaacgggaccgtaagggtacggaatacgaaacggtaacgtagtacggctagactacgactccgtagtcttcacttccc

SEQ ID NO: 102432 - DNA, 574 bp, Homo sapiens
  misc_feature: GYAE6OF02GZGQ2.51.83.H06.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagagcccaccctctcctgcagggccagtcagagtataacagcgacttagcctggtaccagcaagaaacctggaccaggcctacccaggcctcctcatctatggtncactccaccgaggccactggacactccagccaggttcagtcgnaggtcggtctgggacagtacttcgctctcaccatcagcagcctagcgaccgtagtaagtatttcgacgttagttttaattacgtttgtactagactaacgaacgtaaactacgtcggtacccctttagtaccggtacgtccggaacggtaacgaacggtacggaaggtacaacggtaacgtaggtacgtcgacgtacaccacttacgtcgtcgttctactccgttccc

SEQ ID NO: 102433 - DNA, 562 bp, Homo sapiens
  misc_feature: GYAE6OF02HVS75.51.83.H06.1.454.CMB.1.raw
  modified_base (199)..(199): a, c, t, g, unknown or other
  misc_feature (199)..(199): n is a, c, g, or t
  modified_base (406)..(406): a, c, t, g, unknown or other
  misc_feature (406)..(406): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcgaggggaagngccaccctctcctgcagggccagtcagagtattaacagcgacttagcctggtaccagcagaacctggccaggctccaggctcctcatctatggtgcactccaccgagggccacgtggccactcccagccaggttccaggtggctaggtgggtctgggaacaggtacttcgcctctaccacctatcagcagcctagacgcctgaagtntttgactagtttattatttgtctagcacgacgaaacactcgccttcgttacggtacgttccggaccgtaaggaccgtaagggtacgaactacgaaaccggtacgtacggtacggtacgtcgaccacgtacgttccgttgtaccttctacgttcccg

SEQ ID NO: 102434 - DNA, 551 bp, Homo sapiens
  misc_feature: GYAE6OF02I14X7.51.83.H06.1.454.CMB.1.raw
  modified_base (418)..(418): a, c, t, g, unknown or other
  misc_feature (418)..(418): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaagagccaccctctcctgcagggccagtcagagtattaacagcgacttagcctggtaccagcagaaacctggccaggctccaggctcctcatctatggtgcatccacagggccactggcatcccagccaggttcagtggcaggtgggtcgtgggacaggaccttcggctctcacctactcagccacgcctagcgcctgagtatttgctagtttattatttgtntagcagacgtaacactggcctcgttcggtacgttccggccgtaaacgggacctaagggtcgaagtaccgaaacggacgttaggtggacgttcgaccgtaaccgtcttacgttcggttaccttactcttacccg

SEQ ID NO: 102435 - DNA, 539 bp, Homo sapiens
  misc_feature: GYAE6OF02ITYJC.51.83.H06.1.454.CMB.1.raw
  modified_base (199)..(199): a, c, t, g, unknown or other
  misc_feature (199)..(199): n is a, c, g, or t
  modified_base (435)..(435): a, c, t, g, unknown or other
  misc_feature (435)..(435): n is a, c, g, or t
  modified_base (515)..(515): a, c, t, g, unknown or other
  misc_feature (515)..(515): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggcctccaggcctcctcatctatggtgcactccaccgagggccacgtggcactcccagcctaggttcagtgcaggtgggtctgggacagtacttcgctctcaccatcagcacgcctagacgcctagaagtagtttgctagttttattattgtcagcagaccaaanacgtggcctcgttaggaccgttcggaccgaaagggaccaagggtagaactacgaaacgtacgtaggtcgactcgacacgngttacgtgtacctttcgattcccg

SEQ ID NO: 102436 - DNA, 545 bp, Homo sapiens
  misc_feature: GYAE6OF02HWD2S.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanagccaccctctcctgcagggccagtcagagtattaacagcgacttagcctggtaccagcagaaacctggccaggctcccaggctcctcatctatggtgcatccaccagggccactggcatcccagcccaggttccaggtcgcaggtgggtctggggacagaccttcgcttctcaccatcagcagcctagagcctgaagtatttcgcttagtttattatttgtcagctagaccgaaagacctggccttccgttggtaccgttcgaccgaacgggaaccgaggtagaaacgtacgaaacgtaacgtggtaggcgttacgctaccagtccttcgtacttctattcccg

SEQ ID NO: 102437 - DNA, 550 bp, Homo sapiens
  misc_feature: GYAE6OF02IWRHD.51.83.H06.1.454.CMB.1.raw
  modified_base (199)..(199): a, c, t, g, unknown or other
  misc_feature (199)..(199): n is a, c, g, or t
  modified_base (372)..(372): a, c, t, g, unknown or other
  misc_feature (372)..(372): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctccaggctcctcatctatggtgcatccaccgagggccacgtggcactcccagccaggttcagtggcaggtgggtctgggacagtacttcgctctcaccntcagcagcctagacgtcctagaagttatttgactagttttaattgttgactagcagacgaaacacgtggtaccctcgttacggacgttcggaccgaaacgggacctaagggtagaaactacgaaaacgtacgtcggtacggactacggaccaacgtattcgtagtacttctacttccc

SEQ ID NO: 102438 - DNA, 502 bp, Homo sapiens
  misc_feature: GYAE6OF02HERIW.51.83.H06.1.454.CMB.1.raw
  modified_base (199)..(199): a, c, t, g, unknown or other
  misc_feature (199)..(199): n is a, c, g, or t
  modified_base (347)..(347): a, c, t, g, unknown or other
  misc_feature (347)..(347): n is a, c, g, or t
  modified_base (426)..(426): a, c, t, g, unknown or other
  misc_feature (426)..(426): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtattaacagcgacttagcctggtaccagcagaaacctggccaggctcccaggctcctcatctatggtgcatccaccgagggccactggcactcccagccaggttcagtgcaggtggtcngggacagtacttcgctctcactatcagcagcctagacgcctgaagtatttgctagtttattattgtcagcagacgaaanacgtgcctcgtggacgttcggcaagggacaagtaggaactcgaaacgatgtagctgcactctctgtcttcattccc

SEQ ID NO: 102439 - DNA, 565 bp, Homo sapiens
  misc_feature: GYAE6OF02G9EF5.51.83.H06.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (558)..(558): a, c, t, g, unknown or other
  misc_feature (558)..(558): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgaggggaaangccaccctctcctgcagggccagtcagagtataacngcgacttagcctggtaccagcagaaacctggccaggcctccaggctcctcatctatggtgcactccacgagggccacgtggcactcccagccaggttcagtcggcgaggtgggtctgggacagcttcgctctcacatcacgcacgcctagacgtcgtagaagtatttgacttagttttattattgtacagcagaccgaaacgtacgtcggtaccttcgtacggtacgttaccggaccgtaagggaaccgtaagggtacgaaacgtaccgaaacggtacgtaggtacggactacggaccaacctcgttacgttcgtcttacncttcccg

SEQ ID NO: 102440 - DNA, 578 bp, Homo sapiens
  misc_feature: GYAE6OF02JDC0C.51.83.H06.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccagtcagagtataacngcgacttagcctggtaccagcagaacctggccaggcctcccaggcctcctcatctatggtncatcccaccgagggccacgtggccactccccagcctaggttcaggtggctaggtgggtctgggacagtacttcgctcncacntcagcacgctagacgctagaagtatttcgacgttagttttattagttcgtacgagtcacgtaccgaaactacgtcggtacccttccgttacggaccggttccggaccgtaacgggaaccgtaaggtacggaactaccgaaacggtacgtacggtacggtactacgacctaccgtacgtacgtcgttcttctacgttcccg

SEQ ID NO: 102441 - DNA, 526 bp, Homo sapiens
  misc_feature: GYAE6OF02FV6NT.51.83.H06.1.454.CMB.1.raw
  modified_base (198)..(198): a, c, t, g, unknown or other
  misc_feature (198)..(198): n is a, c, g, or t
  modified_base (522)..(522): a, c, t, g, unknown or other
  misc_feature (522)..(522): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaanagccaccctctcctgcagggccagtcagagtattaacagcgacttagcctggtaccagcagaacctggccaggctccaggcctcctcatctatggtgcactccaccgagggccacgtggcactcccagccaggttcagtggcaggtgggtctgggacaggtacttcgctctcaccatcagcagcctagacgtcctagtaagtagtttcgctagttagttattactgtcagctagtacggtagttctatcgtccgtacgttcggaccgaagggaccgaagggtaggaactacgaaacgtactaggtggctcgcacatctgtctcntccc

SEQ ID NO: 102442 - DNA, 595 bp, Homo sapiens
  misc_feature: GYAE6OF02JGY47.51.83.H06.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtataacngcgacttagcctggtaccagcagaaacctggccaggcctcccgaggcctcctcatctagtggtgcatcccaccgacgggccacgtggccactcccagcctaggttcaggtggctaggtcgggtctaggggacaggtacttcgctctccaccatcagcacgcccgtagacgtcctagaagtatttgacgttagtttattagttgtacagcagacgaaactacgtcggcccttcgttacggtaccgttaccggaccgtaacgggaaccgtaagggtacggaactaccgaaacggtaacgttaggtacggtctacggaccctaccgtacgttaccgttcgtaccttacctacgttaccccgg

SEQ ID NO: 102443 - DNA, 573 bp, Homo sapiens
  misc_feature: GYAE6OF02G1YX1.51.83.H06.1.454.CMB.1.raw
  modified_base (199)..(199): a, c, t, g, unknown or other
  misc_feature (199)..(199): n is a, c, g, or t
  modified_base (381)..(381): a, c, t, g, unknown or other
  misc_feature (381)..(381): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaacctggccaggcctcccaggcctcctcatctatggtgcactcccaccgacgggccacgtggcactcccagcctaggttcaggtcggcaggtgggtcgtgggacagtcttcgctctcaccntcagcacgcctagacgtcctagaagtatttgacttagtttattagttcgtacagactagaccgaaactacgtcggtaccttcgttacggtaccgttaccggaccgaagggaccgtaagggtacgaacgtacgaaacggtacgtcggtacggctcggacctaccgtacgttaccgtgtaccttcacgttcccg

SEQ ID NO: 102444 - DNA, 576 bp, Homo sapiens
  misc_feature: GYAE6OF02F5UFH.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctccaggctcctcatctatggtgcactccaccagggcccaacgtggcactcccagccaggttcagtgcaggtgggtctgggacagacttcgctctcacctatcagcacgcctagacgcctagaagtagtttgctagtttattattcgtacagtcagaccgtaaacaacgtcggtaccttaccgttagggaccgtttacggaccgtaaacgggaaccgtaagggtacggtaacgtacgaaaccggtaacttacggtaggtaccgtagaccaccgtacttccgtcgtacctttacctacttcccg

SEQ ID NO: 102445 - DNA, 760 bp, Homo sapiens
  misc_feature: GYAE6OF02IFXKA.51.83.H06.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcgatcgtatacacgaccggtgctcgatttagatcacgtgcgtcgcgggggaggaactgctcagttaggacccagagggaaccatggaagcccccagctcagcttctcttcctcctgctactctggctcccagatgccaccggacaaattgtgttgacacagtctccagtcaccctgtctttgtctccgaggggaangccaccctctcctgcagggccagtcagagtattaacagcgacttagcctggtaccagcaagaaacctggaccaggcctcccgaggcctcctcatcttagtggtncactcccaaccgacgggacccacgtggcctactccccgaagtacccgtaggttccaaggttcggacgtagggttcgggtcggtacggggaactacggtaccgtttcgccttctaccaccctatccgaacgccgtaacggtcccgtaaggaccgtaccgtaaggttaaacgtttagttttacggaacgttttaagtttttaacgtttacgttttcggtaaccgtaacggtacgtaacggtaaaccgtaaaaccgtaaccgttaccgggttacccttaccgggtttacggggtaaccgggtttacccgggaaacccggtaaacggggtaaacccgtaaagggggttaaccgaaaaccgttaaccggaaaaaccgggtaccggtttacgggtacggtacccgttacggaaccctaccgtagttaccgttcggtttaccttaccctacgtttaccccccg

SEQ ID NO: 102446 - DNA, 536 bp, Homo sapiens
  misc_feature: GYAE6OF02HS3H4.51.83.H06.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (352)..(352): a, c, t, g, unknown or other
  misc_feature (352)..(352): n is a, c, g, or t
  modified_base (529)..(529): a, c, t, g, unknown or other
  misc_feature (529)..(529): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctntcctgcagggccagtcagagtattaacagcgacttagcctggtaccagcagaaacctggccaggctcccaggctcctcatctatggtgcactccaccagggccactggcatcccagccaggttcagtggcagtggctgggacngacttcgctcgtcaccatccagcacgcctagacgcctaggaacgtatttgactagttttattatttgtctagctagacaaacaacgtggccctcgttcggacgtttcggaccaacggaccgtaaggtaggaatacgaaacgaacgtgtaggctagacaccgtataccgtgtacttcnttacccg

SEQ ID NO: 102447 - DNA, 560 bp, Homo sapiens
  misc_feature: GYAE6OF02GXLOZ.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagngccaccctctcctgcagggccagtcagagtataacagcgtacttagcctggtaccagcagaaacctggccaggctcccaggctcctcatctatggtgcatccaccagggccactggcactccccagcctaggttcagtggcagtgggtctggggacagacttcgctctcaccatcagcagcctagacgtcctgaagtatttgctagtttattattgtcagtcagtaccgaaactaaccgtggacccttccgttgggtaccgtttcggacccgtaaacgggaccaagggtaggaacgtacgaaacgtaacgtggtacggtactagaccaccgtagtccttcggtacctttccgacttcccg

SEQ ID NO: 102448 - DNA, 745 bp, Homo sapiens
  misc_feature: GYAE6OF02JWF92.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaagagccaccctctcctgcagggccagtcagagtataacagcgacttagcctggtaccagcaagaaacctggaccaggcctcccgaggcctcctcactctagtggtcgcaactcccaaccgacgggccacgtcggcactcccgacgtcccgaggttcaggtcggacgtacggtgggttcgtacggggactaaggtccgttcggccttaccgtaccaaccgtactcgaacgccaacgtcctaaggacgtacccgtaaggtaaacgttagttttacggactttaagtttttaacgtttacgtttacgtaccgtaagtacccgtaaacggtaacccggaaaacttaaccggttcggtaccccgtttaccgttacgggtaacccgggtttacccgggaaaccggtaaaccggggtaaacccgtaaggggttaaccgggtaaaacgttaaccggtaaaaccgggtaacgttaacgggtaccgggtaaccgttacgaaccggtaacccgttaacgttcccgtttacgtttacccgtacttacccgttaacccccg

SEQ ID NO: 102449 - DNA, 683 bp, Homo sapiens
  misc_feature: GYAE6OF02JZPKR.51.83.H06.1.454.CMB.1.raw
  modified_base (197)..(197): a, c, t, g, unknown or other
  misc_feature (197)..(197): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagatgccaccggacaaattgtgttgacacagtctccagtcaccctgtcttgtctcaggggaangccacctctctgcagggccagtcagagtataacagcgacttagcctggtaccagcagaaacctggaccaggcctacccgactcctactactttatgactgactactaccgaaaacgggttcgttagggctaactccccgagccgaaggtttcgaacggttggaccgtagggttcgggtactacgggggactaaggtaacttccaacgttctaccaacctactaccgaaccaaggtacctaaggacgtaccgtagtaacgtatttcgacgttaattttacgttactgtacagtctaaggtactaaacaactcggtacctcgttaccggttcgggaccggtaagggtacccgtaagggtacggtaacgtacgttaacgaaaaccggtacggttacggtaggtacgttaccggacctaaacccgttcgttaccgttacggtttccctttaccggtacttacccgtttaccccgtacgttacctttccgg

SEQ ID NO: 102450 - DNA, 710 bp, Homo sapiens
  misc_feature: GYAE6OF02IODZC.51.83.H06.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaacgtgctcagttaggacccagagggaaccatggaagccccagctcagcttctcttcctcctgctactctggctccagatgccaccggacaaattgtgttgacacagtctccagtcaccctgtctttgtacctccgaaggggaancgcccacccgtctcctgcagggccagtcagagtataacngcgattcgcctggacngcagaacctgcagctccagctctnatcatgtncatccacnggccactggacatcccgagcccgtaaggttccaggtcggacagggttcggtctaggggacctaaggtccttcggcttccgacgaccctagtccaacgacgacgtacccgtaaggaccgtcccgttaagaaaggtttcttttacggaacgtttagttttttaacgaagttttcggacctaaggtcctaaacggtaacccggtaaaacgttaaccggtccgggttaaacccgtttcccgtttaaaggggtaccccggttttacccggggaaaccgtaaaacgggggtaaccccgtaaaggggttaacggaaacgtttaaccggaaaaccggtaaacggttcggtacggtaccgttacggaacccctaaccgttaacggtccttttacgggtaccctttacgaacgtttcccccgg

SEQ ID NO: 102451 - DNA, 900 bp, Homo sapiens
  misc_feature: GYAE6OF02IL0M9.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggaccagagggaaccatggaagcccagctcagcttctcttcctcctgctactctggcctccagatcgccaccggacaaattgtgttgacacagtctccagtcaccctgttctttgtctccgaggggaangccacctctcctgcacgggccagtccagagttacttaaacgcgccgtaacgtttacgccgttaggtaacccaggacaaacggtaaacccgtcgggacccgaacggggtccctacccccgaagggtcccttaccccgtacctaactttacccgttaaggttcggggttacgcctaaaccgtttacccccgaaaccccggaacggggtacccccctaaacggttccgggggtaaccctaacccggttacccccgaaccgggtaccccgttaacggggtttacccgtaaacggggttccgggtaccgttaaacggggggtttcgggggttaacccggttacggggggaacccttaacggggttacccttttcccgggtaccctttccccgttaacccgtaacccccgtaagtttacccgaacggtaccgtaccggtacccgttaacggaccgtaccgtaggtaaacgttagttttaccggacgttttaacgttttactttagtttcgtaccgtacgtacgtaacgaaccgtaaacgtaacgttacggtaccctttaccggttaggttacccggtttccgggaacccgtaaacgggtaacccggttaaggtaacgggtaaccgtaaccgtaacggtaaccgtaggtacggtaccgttaacgccgttaaccacgttccgttacgttaccttacgtaccttacccgg

SEQ ID NO: 102452 - DNA, 541 bp, Homo sapiens
  misc_feature: GYAE6OF02G6SEG.51.83.H06.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtataacagcgacttagcctggtaccagcagaacctggccaggctccaggctcctcatctatggtncatccacgngggccagtggacactcccagcccaggttcaggtggcaggtggtctgggacagacttcgctctcacctatcacgcagcctagcgctagaagtctttgcttagtttattattgtacagtcagacgaaactacgtcggccttcgttggacgttcggaccgaacgggtaccgaggtacgaacgtacgaaacgtacgtaggtacggtctagaccgtaaccgtatccgttcgtacttacattcccg

SEQ ID NO: 102453 - DNA, 767 bp, Homo sapiens
  misc_feature: GYAE6OF02I6UUN.51.83.H06.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
tcagcgatcgtatacacgaccggtgctcgatttagatcacgtgcgtcggcgggggaggaactgactcagttaggacccagagggaaccatggaagccccagctcagcttctcttcctcctgctactctggctcccagatgccgaccggacaaattgtgttgacacagtctccagtcacctgtctttgtctccgaggggaaangccaccctcncctgcgacgggccagtcagagtataacngcgacttagcctggtaccagcacgaaacctggcccaggcctcccgaggtcctccctcactctagtggtnacgactcccaccgacggccctacgtcgggcctacctcccgaggtcccgtagggttccgaaggtcgggtaccgagggttcggggtcgttaccggggactaacgggtacccttccgccgtttacctaccctaacctagtaccgaacggtccgaaccggtacccgttaagggaacgtcccgtaggtaaacggtttattttaccgggacttttaagttttaactttacgttcggttacctaagaaccgtaacggtaacccgttaaaacgtaaccggttccggttacccgttacccggtttaacggggacccgttttaccggggtaaccgaaacggggtaacccgtaaagggttaacgggaaaccttaccggaaaacccggttaaggttacgggttacgggtacttaccggaaccttacccgagtttccggttacgtttaccctttacaccccggtttacccg

SEQ ID NO: 102454 - DNA, 701 bp, Homo sapiens
  misc_feature: GYAE6OF02HYZ7Y.51.83.H06.1.454.CMB.1.raw
tcagcgatcgtatacacgaccggtgctcgatttagatcacgtgcgtcgcgggggaggaacgtgctcagttaggacccagagggaaccatggaagccccagctcagcttctcttcctcctgctactctggctccagatgccaccggacaaattgtgttgacacagtctccagtcaccctgtctttgtctccagggaaagagccaccctctcctgcaggccagtcagagtgttagcagcgacttagcctggtaccagacagaaaccgtggaccaggcctcccgaggcctccgtcaattctaatgatcgacactcccaacgaacgggcctaacgtgaataccgttccccaagaccgtaagggtttaccaggttaggccgtaaggttggggtttccgaagggaccgtagggtaacgttcacgtccttacgaacctatacgacggacgtaacgtccgtacgacgtacgttacgtagtaaaggttatttttaggaaccctttaaagttttactttaacgttacggttaccaaaggttcctaaaggttaaacttaaacgttaacgtacgggtaccccttaaccggttaaccttacgtttttacgggaccgtaacgggggtaacccaacggttcgtaacggtaatacgttaaccgaaaaaccgtacgttacggttaacggcgtttaacggacctaacctagtttacccg

SEQ ID NO: 102455 - DNA, 684 bp, Homo sapiens
  misc_feature: GYAE6OF02GWTI3.51.83.H06.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
tcagcgatcgtatacacgaccggtgctcgatttagatcacgtgcgtcgcgggggaggaacgtgctcagttaggacccagagggaaccagtggaagccccagctcagcttctcttcctcctgctactctggcctccagatgccaccggacaaattgtgttgacacagtctccagtcaccctgtccttttgcctaccgaggggaanacgccacctctcctgcagggccagtcagagtataacagcgtacttagcctggtaaccagcaagaacctggccaggcctcccgaggcctacctcatctagtggtcncactccacgacggccaagtcggcaacgtcccagccctaaggttcaggtggcgaggttcgggtacgtcggggaactacggcgtttccgcttcctacgaccctagtcaagcctacgccctaaggacctccgtaaggtaattacggttttagcctttaaaggtttttacctttaagtcggtttaccaaggtacgtacgaaccgtaaaacgacgttcgggaccctttaccgttagggaaccgtttcggaacccgtaacgggaaacccgtagggtaaaccgtaagtaaccgtaaaaccggtaaacggttacgggtcggtaacgtaccggtaccgaacccggtatttccggtagtttacccgttacgttacttacccccgg

SEQ ID NO: 102456 - DNA, 794 bp, Homo sapiens
  misc_feature: GYAE6OF02HG003.51.83.H06.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaagngccaccctctcctgcagggccagtcagagtataacagcacttagcctggtaccagcaagaaacctggccaggctcccgagcctcctcatctatggtncatcccaccgagggtccacgtggccaatcccgacgcctaggttcagtcggacaggttcgggtacgtagggaccgtagtaccgtttccgccttccttacccgaccctagttccgaacgcctaacgtcccgttaaacggacggtacccgttaggtaaaacggtttacgtttttacggaaccgttttaaagggttttttaacttttaagttttacgggtttacctaacgggttaaccgtaaacggtaaacccgtaaaaaacgtacccggttaaccgggttaccccgttttacccggtttacgggttacccgggttttacccgggaaccccggttaaaaccggggtaaaccgtaaacggggttaacgggtaaaaccgtttaaccgtaaaaaaccgggttaaaccgttacgggttaaccgggtacgttaacccggtaccgttaaaccccgtacgttaccggtttaaccgtttacccgtttacccgttaaccgtttcccccgg

SEQ ID NO: 102457 - DNA, 753 bp, Homo sapiens
  misc_feature: GYAE6OF02GURFV.51.83.H06.1.454.CMB.1.raw
  modified_base (199)..(199): a, c, t, g, unknown or other
  misc_feature (199)..(199): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccacctctcctgcagggccagtcagagtattaacagcgacttagcctggtaccagcagaacctggccaggctccagctcctnatctatggtncactcccaccgagggccctacgtcggaccactcccgacgccgtaggttccaggttcggaccgagggttcggggtaccgttagggggaacctacggtacctttaccggccgtttacccgtccaacccgtagttaccgaacggtaccgtacggtacccgtaacggtaacgtacccgttacggtaaacggttaacgttttacggttaccgttaacgttttaacgttttaacgttttacgttaccgtaacgtaccgtaacgtaaccggtaaaccgtaaccgttacggtacccgttacccgtttacggtaccggtttaccgggtaacccggaaacgggtttttaacccgaacgggttaacgggtaaacgttaaccgtaaaaccggtaacggtaacggttacgggtaccgtacgtaccgtaacccgtacgttaccgttacgttaccgtttaccgtaccgttaccccg

SEQ ID NO: 102458 - DNA, 736 bp, Homo sapiens
  misc_feature: GYAE6OF02F37DZ.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtataacagcgtacttagcctggtaccagcagaaacctggccaggcctcccgaggctcctcatctatggtgcactccaccgagggccacgtggcactcccgagtccaggttcaggtcggactagggtgggtcgtagggactacggtacttcggccttccgtaccaacctagtccagccacgtccgtagacgtccgtagaacgttagtttcgacgtttagttttacttagtttcgttacgtacgtaccgtacggtaaaccgtaaaacgttaaccggttacggtacccccgtttaccggtttaaccgggttaacccgggtttaccggggtaacccggtaaaaccgggggtaacccgtaaacgggggtttaaccggtaaaaccggttaaccgtaaaaaaccggggttaacggttaacgggttaccgggtaaccgttaccggtaacccgtaacccgtttacggttacccgtttacggtttacccgtttaccgttaacccggttttaccccccgg

SEQ ID NO: 102459 - DNA, 564 bp, Homo sapiens
  misc_feature: GYAE6OF02G1L3K.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanagccaccctctcctgcagggccagtcagagtattaacagcacttagcctggaccagcagaaacctggccaggcctcccaggcctcctcatctagtggtgcatcccaccgacgggccacgtggcactcccacgcctaggttcaggtggcgagggttgggtcgtggggacaggtaccttcgcctctcacctatcagcacgcctagacgctagaagtatttgacttagtttattagttgtcagtcagacgaactacgtcgtaccgtcgttaggtacgttcggaccgtaacggaccgaaggtagaacgtacgaaacgtacgtcggtcggccgtagacctactcgttacctcgtacttactacttcccg

SEQ ID NO: 102460 - DNA, 592 bp, Homo sapiens
  misc_feature: GYAE6OF02GRURR.51.83.H06.1.454.CMB.1.raw
  modified_base (395)..(395): a, c, t, g, unknown or other
  misc_feature (395)..(395): n is a, c, g, or t
tcagcgatcgtatacacgaccggtgctcgatttagatcacgtgcggtacggcgggggaggaactgctcagttacggacccagagggaaccatggaagccccagctcgagcttctcttcctcctgctactctggctcccagatgccaccggacaaattgtgttgacacagtctccagtcaccctgtctttgtctccgaggggaaagacgccaccctctcctgcagggccagtcagagtattaacagcgacttagcctggaccagcaagaaacctggccaggcctccaggcctcctcatctatggtgctatccaccgagggcccactcggcactcccagccgaggttcaggtcggcgaggtcgggtcgtggggacaggaccttcgacctctccaccntccagcacgcctaggacgccgtagagtatttggcttagtttattacgttgtacagtcacggacaaacgacgtcgaccgttcgttcggtaccgttcggaccgaacgggtaaccgaaggtaggtaacgtaacgaaacggtacgtaggtacgtacgtacgtacgaccgttagttccttacgttccttacgtagttccccg

SEQ ID NO: 102461 - DNA, 691 bp, Homo sapiens
  misc_feature: GYAE6OF02IAXXX.51.83.H06.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (236)..(237): a, c, t, g, unknown or other
  misc_feature (236)..(237): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
tcagcgatcgtatacacgaccggtgctcgatttagatcacgtgcgtcgcgggggaggaactgctcagttaggacccagagggaaccatggaacgccccagctcagcttctcttcctcctgctactctggctccagatgccaccggacaaattgtcgttgacaacngtctacagtcacctgtctttgctcgaagggaacngccacctctccngcagggccagtcagagtactaaacnncgtacttagcctggaaccngcaacgtaaacctggaccaggtccnccgagcctcctnactcagtggcacactccacgaggacctagccgganacctaccgacgaccgtacggttcaggtcgctaagggttcggttcgagggacaggtacttcgctccgtacctacactacgaaccgtctaacgaccgtaaggaccgtaccgttaggaaacgttaagtttcgtaaccgtttaaggttttattaacgtttaccgtagaacggttacgtaaacgaccggtaaaaactaccgttcgggttaccttacccggttagggtaccggttaccgtaaaccggtaaacgggtaaacctaaacggggtaacgaacgttaacccgaaaacggtaacgttacggttacggaccgttacgtaaccgtaaccctcttaccgtaggttcccttacggtacctttaccccgg

SEQ ID NO: 102462 - DNA, 674 bp, Homo sapiens
  misc_feature: GYAE6OF02F2Q1T.51.83.H06.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagngccaccctctcctgcagggccagtcagagtataacgngcgacttagcctggtaccagcagaaacctggccaggcctccaggcctcctcatctatggtgcatcccaccgagggcccacgtcgggccatccccgagccctagggttccaagggttcggactagggttcggggtaccgtggggaacctacggtaccttccggcttccgtcccaaccgtactcgaacgccgacgacccgtaggaccgtccgtagaacgtttatttcgaccttaaggttttactttagtttgtacacgtacgtaggaaccgtaaactaaccgtcggtcccgttaccgttacgggtaccgttaccgggaacccggtaaacgggaaccgaacggggttaggaaacgtaaccggaaaacggtacgttacgggtaggtacccgttagaccctaaccgtattccgttaggttacccttactaaccgttccccg

SEQ ID NO: 102463 - DNA, 558 bp, Homo sapiens
  misc_feature: GYAE6OF02IXM0L.51.83.H06.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
  modified_base (364)..(364): a, c, t, g, unknown or other
  misc_feature (364)..(364): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcaggggaaanagccaccctntcctgcagggccagtcagagtattaacngcgacttagcctggtaccagcaagaaacctggccaggctccagctcncatctatggtgcatccacaggccacgtgcatccagctaggttcagtggcaggtggtctagggacagtacttcgctctcacntcagcagcctagacgtcctagaacgttatttagacttaagttttattaagtttgtacagcaaggaaccaaactacgtcgccttacgttaggaccgttacgaacgtaaacgggacctaagggtacgaatacgaaacgtacgttaggaggtactacgactaccgtacgttcctaggttaccttacgacttaccccg

SEQ ID NO: 102464 - DNA, 643 bp, Homo sapiens
  misc_feature: GYAE6OF02FHT6Z.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaancgccaccctctcctgcagggccagtcagagtattaacagcgacttagcctggtaccagcagaacctgccaggctccagcctcctcatctagtcggtgcactccgaccgacggccacgtcggcactcccagtccctaggttcaggtggacgtaggtcggggtcgtaggggactacgtaccgttccgcttcgtaccaccgtatccgacgtcacggcctagacgtccgtagtaacgttcgtttgacgtttaagttttacttagttacgttcgacgtcgtaagtaaccgaaacgttacgtccgtacccgtttacgttacgggtaaccgtttaccgggaccgtaaacggggaccgaagggttacggaaacttaccgaaaacggtacgttacggacggtcgtaaccgcgtaacccgtattccgttacgttccttacgtacccttcccgg

SEQ ID NO: 102465 - DNA, 553 bp, Homo sapiens
  misc_feature: GYAE6OF02GPM8F.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctccaggctcctcatctatggtgcatccaccagggccactggcactcccagccaggttcagtggcaggtgggtctggggacaggacttcgctctcaccatcagcacgcctagacgcctagaagtatttgcttagtttattatttgtacagcagacgaaacacgtcggacctccgttggaccgttcggacgtaaagggaaccctaagggtacgaaactacgaaacggtaactacggtacggctagacccgtactacgttccgtagttcttactattccccg

SEQ ID NO: 102466 - DNA, 878 bp, Homo sapiens
  misc_feature: GYAE6OF02I67OL.51.83.H06.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccgaggggaangccacctctcctgcagggccagtcagatataacagcgacttagcctaggtaccagccaagaaacctggacccaggcctccgaggtcctcctcattccgtagtggtcncctacgtcccgaccggagggcccaacggtcggcctacgtcccgagtcccgtaggttccaggttcggacgtaggggttcgggtactaggggaacacggtaccgtttccggcctttaccgtacccgaaccctagttacccgacggtaccgtaacgtccccgttaaagggacccgtacccggttaagggttaaaacgttttacggttttttaccgggaacccgtttttaaagggttttttttaaccttttaacggttttaccgggtttaacccgtaaacgggttacccgtaaacgggttaaaccccggttaaaaaaccgtttacccgggttaccggggttacccccgttttaccgggtttaccgggggttaacccgggttttaccccggggaaaccccggggtaaaaccgggggtaaacccggtaaacgggggtttaaccgggtaaaaccgttaacccggtaaaaacccgggttaccggttacggggttaaccgggtacccgtaacggtaaccctaacccggttacgtttacccggttacggtttacccctttaccggtaaccccgttttccccgg

SEQ ID NO: 102467 - DNA, 737 bp, Homo sapiens
  misc_feature: GYAE6OF02G26OJ.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaanacgcccaccctctcctgcagggccagtcagagtataacagcgacttagcctggtaccagcaagaaacctggaccaggcctcccaggcctcctcatctagtggtcgcactcccgaccgacgggcccacgtcggactacctccccgacggcccgtacggtttacgaggttcggactaggggttcggggtacgtacggggaacaggtaccgtttcgcccttacctaccaaccctacttccgaacgccgtaacgtacccgtaaggaccgtaccgttaggtaaacgttacgtttttacggacgtttaaagttttaatttacgtttacggtacctaagtaccgtaacgtaaaccggtaaaacctaccggttaccggtacccctttacggtttacgggtacccggtttccggaaacccggaaacggggtaacccgtaaaggggtaccgtaaaacgttaccgaaaaccggttacgtacggttacgggtaccgtacggtaccgaacctacggttccgttacggttacctttaccacgtttaccccg

SEQ ID NO: 102468 - DNA, 631 bp, Homo sapiens
  misc_feature: GYAE6OF02G0YZA.51.83.H06.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtcctttgctccaggggaancgccaccctctcctgcagggccagtcagagtataaacngcgacttagcctggtaccagcagaaacctggaccaggcctcccgaggcctaccctcatcctatgtcgcatcccaccagggccacgnggtcactcccagccaggttcaggtcggctaggtgggtactggggacagtacgttcgcttccgtacacactacacgctacgcctaacggacaccgtagaagttatttcggacttagttttaagttaatttgtacgaagtcgaaacacgtaaaaccacgttcggtacccttccgttacggtacgttccgggtaaccgtaaacgggtaaccctaaagggtaacgggtaaaccgtacgtaaaaccgaacggttacggtaacggtactaccgaccgtaactacgttccgtacgttaccttacgacgttaccccg

SEQ ID NO: 102469 - DNA, 711 bp, Homo sapiens
  misc_feature: GYAE6OF02IZAGN.51.83.H06.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccacctctcctgcagggccagtcagagtattaacagcgacttagcctggtaccagcagaaacctggccaggcctcccgaggctcctcatctatggtnctatcccacgacgggccaacgtcggaccactccccgagtcccgtaaggttccaggtcggcctagggttcgggtcgtaggggaacctaggtacctttcgacttcctaccgaccctagttccaagcctaacggaccctaaggacgtccgtaggtaaacgttagttttcgacgttaagtttttaacttagtttcggttactacggtacgtaacggtaaccgtaaaaccgtaaccgttaccgggtacccgtttaccggttacggggtaacccgttttaccggggaacccgtaaaacggggtaacccgtaaaggggttacggaaacgttaaccggtaaaaccggtaacggttcgggttacggtaccgtacggacccgtacgttacttaccgttacgtttaccttaccgtacgtttccccg

SEQ ID NO: 102470 - DNA, 572 bp, Homo sapiens
  misc_feature: GYAE6OF02GLFST.51.83.H06.1.454.CMB.1.raw
  modified_base (198)..(198): a, c, t, g, unknown or other
  misc_feature (198)..(198): n is a, c, g, or t
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
tcagcgatcgtatacacgaccggtgctcgatttagatcacgtgcgtcgcgggggaggaactgctaagttaggacccagagggaaccatggaagccccagctcagcttctcttcctcctgctactctggctcccagatgccaccggacaaattgtgttgacacagtctccagtcaccctgtctttgtctccaggggaanagccaccctctcctgcagggccagtcagagtattaacagcgacttagcctggtaccagcagaacctggccaggctcccaggcctcctcatctatggtgcatcccaccgagggccacgtggcactcccagccgtaggttcagtggctaggtgggtctgggacagtcttcgctcacacntcgagcacgactagacgcctagtaagtnttttcgacttagttttattagttgtctagtacagacgaaactacgtcgaccttccgtaggtacgttcggaccgtaacgggaccgaaagggtagaaataccgaaacgtacgtcggtacggtaccgtagacctaacgtacttcgtacgttccttactacttcccttacccg

SEQ ID NO: 102471 - DNA, 558 bp, Homo sapiens
  misc_feature: GYAE6OF02JGIBO.51.83.H06.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccaggggaaangccaccctctcctgcagggccagtcagagtattaacagcacttagcctggtaccagcagaacctggccaggctccagctcctcatctatggtncatccacagggccactggcatcccagccaggttcagtggcaggtggtctgggacagacttcgctctcaccatcacgcacgcctagacgcctagaagtatttgactagtttattattgtactagcagtacgaaacacgtcggtacccttacgttcggtaaccgtttccggaccgtaaacgggtacctaaggggtacgaaacgtacgaaacggtaacgtggttacggcttacggactacccgtagtccgttgtaccttctacttacccg

SEQ ID NO: 102472 - DNA, 689 bp, Homo sapiens
  misc_feature: GYAE6OF02H5EAQ.51.83.H06.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctcgaggggaaangccaccctctcctgcagggccagtcagagtattaacagcgattaggcctggtaccagcagaaacctggccaggctccaggctcctcatctatggtncactcccaccgacgggcccacgtcggcactccccgagccccaggttccaggtcggcgaggtcgggtcgtggggacaggtcttccgcttcctctaccacttccgacgccacggtccctaggacgtcccgttaggtaaacgttagttttggaccgttttaatttttaagttttaattttcggttccttaagtctacgaaccgtaaaaccgtaaccgttcggtccccgtttcccggttttacgggtacccggttttcccgggaaaccgggtaacggggtaaaccgtaacggggtaggtaaaccgtacggtaaaacccggtaaggttaacgggttcgggtcgttaccgtaccgtaccgttacgttccggtttcggtttcctttccgtacgttttccccg

SEQ ID NO: 102473 - DNA, 661 bp, Homo sapiens
  misc_feature: GYAE6OF02GY4UY.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagagcccaccctctcctgcagggccagtcagagtattaacagcgacttagcctggtaccagcagaaacctggccaggctcccgaggcctcctcactctatggtgcactcccgaccgacgggccacgtcggcacgtcccgagccctaggttcaggttggactagggtcgggtctagggggacacggtaccttcgcctacctccaaccactcgacgccgacgtccgtaaggacgtccgtaggaacgttagttttcgacgtttagttttatttagttgttcagtcgaacgacgtaaacacgttcggtaccctacgttccggtaaccgtttccggaaccggtaaacggggaacccgtaaggggtaacgtaacgttaaccggaaaacggtacggttacggtacgggtaccttacggaccctaaccgttacgttaccgttaccggtttcctttaccgacttttcccccg

SEQ ID NO: 102474 - DNA, 778 bp, Homo sapiens
  misc_feature: GYAE6OF02IPJ4G.51.83.H06.1.454.CMB.1.raw
  modified_base (215)..(215): a, c, t, g, unknown or other
  misc_feature (215)..(215): n is a, c, g, or t
  modified_base (488)..(488): a, c, t, g, unknown or other
  misc_feature (488)..(488): n is a, c, g, or t
tcagcgatcgtatacacgaccggtgctcgatttagatcacgtgcgtcgcgggggaggaactgctcagttaggacccagagggaaccatggaagccccagctcagcttctcttccctctgctactcgtgcctccagatcgcccgaccggaactaaagttgtgttcgacactacgtcctccacgtccaccctgtctgtcgtctccggaaggggaaancgccccacccctctccgtgcgacggccagtcagtagttggttacgcaggtccgtacttacggccgtacggtaaccgagaccaacggaaacccgtccgggaccgacggccccctacccgacggtccctccctacgtacttaccttaacgtgtacgtgaccctactacccgaaccggaaccgggccctaacgttagtaactacccgtacccgaccggaccgtacggttcgacggtcggacgtaggtggtccggtagggacctaaggtccgttacnccttacaccaccgtataccgacgacctacgtcccgtacgtcgtacgtgtaacggtaacgtttagtttacgtaactttaacttttaacgttacgttacgtatacgtaacgttaagttaaacgtaaccttaaccggttcccggtaccctttacccgggttaccgtttacccgggttaccgacccgggttaaccggggaacccgaacggttcggtaaccgggaattaaccggaaacccgtaaaaccgggtacggttccgggtacggtacccgtacggtacccctaagttcccg

SEQ ID NO: 102475 - DNA, 534 bp, Homo sapiens
  misc_feature: GYAE6OF02FNXV2.51.83.H06.1.454.CMB.1.raw
  modified_base (199)..(199): a, c, t, g, unknown or other
  misc_feature (199)..(199): n is a, c, g, or t
  modified_base (361)..(361): a, c, t, g, unknown or other
  misc_feature (361)..(361): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccacctctcctgcagggccagtcagagtattaacagcgacttagcctggtaccagcagaaacctggccaggctcccaggctcctcatctatggtgcatccaccagggccacgtggcatcccagccaggttcagtgcagtggtctgggacagacttcgctcncaccatcagcagcctagacgcctgtaacgtatttcgactagtttattattgtacagcagcgaaactactggtacctccgttaggtacgttcgccgaaaggaccaagggtacgaactacgaaacgtaacgtacggtacggcttacgactaccattccgtactcttacattcccg

SEQ ID NO: 102476 - DNA, 701 bp, Homo sapiens
  misc_feature: GYAE6OF02JTG89.51.83.H06.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggactaaattgtgttgacacagtctccagtcacctgtctttgctcgagggaangcccacctctccgtgcgaggccagtcagtagtataacngcgtacttagccttaggtaccagacaacgaaacctggaccaggcctacccgaggtccctacctcacttcctagtcggtcgcactcccgacgtacggaccacgtcgactactcccgagccgtacggtcaggtcgacgtaggtcgggtacgtacgggactacggttaccgttccgtacctactaccacctacgtccgaggaccgtaccgtacccgtaggacgtacccgtagttaacgttactttagaccgtagttcgttaactttcgtcggtaacacggtaccgttaacgggttacgtttacgtaacgtacgttacccggttacccggtaccgggtttacccggaacggtaaacgggaacgtaaacgggttaacgggaaccttaacgaaacccgttacggtacggtcggtaaccgacgtacccgtaccgtacgttaccgttccggtaccttccttaccgttaccccgg

SEQ ID NO: 102477 - DNA, 583 bp, Homo sapiens
  misc_feature: GYAE6OF02F0COK.51.83.H06.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtagttgacacagtctccagtcaccctgtctttgtctccaggggaaangccaccctctcctgcaggccagtcagagtataacngcacttagcctggtaccagcagaacctggccaggcctccgaggcctcctcatctatggtncatccacgnggccagtgcatcccagcctaggttcaggtcggctaggtgggtctaggtacaggtaccttcgcttctaccacctatcgagcacgtcctagacgtcctagtaacgttatttgacttaagttttattattgtcagcaagtacaaactacgtcggtcccttccgttggtaccgttaccggaccgtaacgggaccgaagggtacggaactaccgtaaacggacgttaggtacggtacctagaccctaacgtacttaccgtcgttaccttaccgtacttaccccg

SEQ ID NO: 102478 - DNA, 695 bp, Homo sapiens
  misc_feature: GYAE6OF02GORKB.51.83.H06.1.454.CMB.1.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagngcccacctctcctgcagggccagtcagagttaactaacagcgtacttagccctgggtaaccagacaagaaaccctggaccaggcctcccgaggtcctcctctaatccgttagtgggtnacctctacccaccggagggaccacggtcgactacctcccgagtccgaacggtttcaggtcggacctaggggttcgggtccgtaggggacctaggttacccttcgccttacctaccacctactcgacgtcctaacggaccctacggtacgtaccgttaagtaaaccggtttatttacggaactttaaattttaacggtttactacggtttacaacgtaacttaaggtttaaactaaaaccgttacggttaccgttccctttaaccggttaaccgtttaacggtttccggaacggaaccgggtaacaggtccgtaggaccgtaagtaaccgaaacggttacgtcgtagcctagaccctacgtactggtaccttgtacc

SEQ ID NO: 102479 - DNA, 790 bp, Homo sapiens
  misc_feature: GYAE6OF02HPQSB.51.83.H06.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgtctttgtctccgaggggaaagngcccaccctctcctgcagggccagtcagagtattaacngcgacttagcctggtaccngcaagaacctggccaggcctccaggctcctcatctagtggcgctacgtcccacgacgggcctacgtcggacctactaccccgacgtccgtacgggtttaccagggtcggacgtaggggttcggggttaccgtaggggaacctaacggtacctttccgacctttacccgtaccaaccctaagtcccgaacgccgtaaccgtacccgtaaggaaccggtacccgtttaaggaaacggttttacgtttttacggaaccgttttaaggttttttaatttaacggttttacggtacgttacggtaaccgtaacggtaaacccggtaaaacctaacccgggttaccggtaccccgttttacccggtttacgggtaacccggtttacccggggaaacccggtaaacggggaaacccgttaagggtaaccggtaaacttaccggaaaaccgtaacggttcgggttaacggacggtaccgtaacccgtaaccgttaccgttaccgttacggtttaccctttaccgtaccgtttacccccg

SEQ ID NO: 102480 - DNA, 720 bp, Homo sapiens
  misc_feature: GYAE6OF02GMNUH.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaanagccaccctctcctgcagggccagtcagagtattaacagcgacttacgcctaggtaccagacacgaaaccgtggaccaggcctcccgaggcctcctcatctagtggtcgcactcccgaccgacgggcccacgtcggcaaccgtcccgagaccgtacggttcgaggtcggacgtacgggtgggtccgttagggaacgtacgtaccgttccgcttacctaccaccctaactcaacgacgaccgtaccgttaacgggacgtacccgttaaggtaaagtttacgttttgggtaacctttaagttttttaacgtttaagtttcgttacgtacgtaacgtaaccgaaaccggaaacttaccggtacggttacccctaccggttaccgggtaccgggtttacccgggaccgtaaaccgggaaccggtaacgggtaacggtaacgtaaccgaaacggttacgttacggtacggtaccgtacgacctaccgtaacttcggtaccgtttacttaccgtacctttaccccgg

SEQ ID NO: 102481 - DNA, 717 bp, Homo sapiens
  misc_feature: GYAE6OF02H8EPN.51.83.H06.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (287)..(287): a, c, t, g, unknown or other
  misc_feature (287)..(287): n is a, c, g, or t
  modified_base (591)..(591): a, c, t, g, unknown or other
  misc_feature (591)..(591): n is a, c, g, or t
  modified_base (654)..(654): a, c, t, g, unknown or other
  misc_feature (654)..(654): n is a, c, g, or t
tcagcgatcgtatacacgaccggtgctcgatttagatcacgtgcgtcgcgggggaggaactgctcagttaggacccagaggaaccatggaagccccagctcagcttctcttcctcctgctactctggcctcccagactggccaccggaactaaattcgtagttgacacagtctccagtcacctgtctttgctcgaggggaaancgccaccctntccngcgacggcagtcagtagtataaacgactacttacgcctaggtaccagacctaacggaaaccttggaaccncggtcctacccgaggtaccttcccgctacgttaccttagtggcgtacctaccgtacccgacccggaggccctacgcgggtaccctaaccgttccccacgggacccgttaagggttcccgtaaggtccgggcgtaacgggttcgggtaccgtacgggggaactaacgggacttttcccggtcctttaccgtaccgacctaacgttaccgacggtacgtccggaccctaaggggtccctaaccggtaaggtaaacgtttccgtttacggtaacgtttaactttttaagttagtttacgtcgaacgngtaaccgaacgtaaaccgtacgtcggtcccttaggttcgtcgtaacgaccgtaggacaagggntaactagaaacggtatcggtacggactcgactacgtaacgtcgtttctacttactcgtccccg

SEQ ID NO: 102482 - DNA, 538 bp, Homo sapiens
  misc_feature: GYAE6OF02FG3Y9.51.83.H06.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
tcagcgatcgtatacacgaccggtgctcgatttagatcacgtgcgtcgcgggggaggaactgctcagttaggaccccagagggaaccatggaagccccagctcagcttctcttcctcctgctactctggctcccagatgccaccggacaaattgtgttgacacagtctccagtcaccctgtctttgctccaggggaaanagccaccctctcctgcagggccagtcagagtattaacngcgacttagccctggtaccagcagaaacctggcccaggctcccaggctcctcatctatggtncatccaccagggccactggcatccccagcccaggttccagtggcaggtcgggtctggggactaggactcggctctcaccgatcagcagcctagacgctgaagtatttgactagtttattattgtctagcagacgaaacacgtgccttccgttggtaccgttccggaccaacggaccgaagggtagtaacgtacaaacggaactagtacggctgaccaccacgtcgtgtccttctatccc

SEQ ID NO: 102483 - DNA, 748 bp, Homo sapiens
  misc_feature: GYAE6OF02FSA6Z.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccgggacaaattgtgttgacacagtctccagtcaccctgtctttgtctccaggggaaangccaccctctcctgcagggccagtcagagtattaacagcgacttagcctggtaccagcagaaacctggccaggctccaggcctctcatctatggtgcatcccaccgagggccacgtcggccacgtccccagcctaagggtttcaagggttcggcgtacgggttcggggtacgttaggggactaacggtacctttcgggccttacccgtcctaacccgaacgtttaccgaacggtaccacgggtaccccgttaagggaccggttcccttaagggtaaacgttaacgtttttcggaccgtttacgttttttaatttaacggttcgttaaccgacggtaccgtaaacggtaccggtaaaactaaccggttccggtacccgtttcccggtttaacgggtacccggtttaccgggacccgtaaaccgggggaaccctaaaggggttacggtaaacgttacccggaaaacggtaacgttacggtacgggtaccttacggtacccgaaccgttcgttaccgttacggtttacccttacgtacccgtttacccccg

SEQ ID NO: 102484 - DNA, 663 bp, Homo sapiens
  misc_feature: GYAE6OF02JAM0Y.51.83.H06.1.454.CMB.1.raw
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtagttgacacagtctccagtcaccctgtctttgtctccaggggaagacgccaccctctcctgcagggccagtcagagtataacagcgacttagcctggtaccagcagaaacctggccaggcctcccaggctccncatctangggtncactcccaccgcgggccacgtcgggacacgtccccaggcccgtaggtttccaggtcggcgtagggttgggtaccgtaggggacacggtacgtttaccgccttacttcccgacctattccgaagccgagtacccgtaggacgtacccgtagtaagttacgttttaggctttaagttttatttagttttacgtctaacggctaagaccggtaaacctacgtaccggtcccttaccggttcggttaaccggttccggaaccgaacgggtaccgaaggggtaacgaacgttacgaaaccggtaacgttacggtggaacggttcgacgtacctacgtaccgttcggttcctttactacggtttaccccc

SEQ ID NO: 102485 - DNA, 814 bp, Homo sapiens
  misc_feature: GYAE6OF02ITR3B.51.83.H06.1.454.CMB.1.raw
  modified_base (199)..(200): a, c, t, g, unknown or other
  misc_feature (199)..(200): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcggcgggggagaactgctcagttaggacccagagggaaccatggaagccccagctcagcttctcttcctcctgctactctggctcccagatgccaccggacaaattgtgttgacacagtctccagtcaccctgtctttgtctccaggggaacnnccaccctctcctgcagggccagtcagagtattaacngcgacttagcctggtaccagcaagaaacctggaccaggtcctacccgaggtccctccgtacaacttccttaatcgggtacgacctacgttaccaaccgtacggggcccaacgttcggaccaactccccgaagcccgtagggtttaccaaggttcggacgtaacgggttcgggttaccgtagggggtaccaacgggttacctttaccgggtccttaccgttaccgaaaccctacgttaaccgtacggtaccgacggtacccgttaaagggaaccgtcccgttaaggtaaacggtttacgtttttacggacgttaaaggttttttacttaaagttttcgtaactaacggtaccgttaagtaacccggaaaacttaccggttacggtccctttaaccggtttagggaacccgggttttaccgggaaacccggtaaaacggggtaaccccgtaaaggggttaaccggtaaacttaacccgggaaaaaccggttaacggttaccgggttagggacccgttaccggtaaccgaaccccttaagtttcccgtacggttttactttaccggtacccttaaccccgg

SEQ ID NO: 102486 - DNA, 772 bp, Homo sapiens
  misc_feature: GYAE6OF02GGB9V.51.83.H06.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtcctccagtcaccctgtctttgtctccgaggggaancgcccaccctctccgtgcaggccagtcagagtataacngcgtacttagcctggtaccagcagaaaccgtggaccaggcctcccgaggcctcctcactctagtcgggtcncctactaccccaaccggtacgggccctacgtcgggacctaccgtaccccgagtcccgtaggtttccagggtcggaccggtgggttacggggtccgtagggtaactacggtacccttcggccttcccgtaccgaaccctacgtccgtacgccgtaacgtaccctaaggaccgtacccgttaagtaaacgtttcgtttacggacctttaaaggtttttaacttacgttttacggtaccgtaaggtacccgtaacgtaaacccggtaaacgtacggttacccgggttaccccttccggggtttaaccgggttacccggttacccgggaaacccgtaaacggggtaacgtaacggggttaacctaacgtaaccggtaaaacgttccggtaacgggtaccggtaccgtaacgtaaccccgtacgttaccgttaccgttaccggttcctttaccgtccccgtttacccg

SEQ ID NO: 102487 - DNA, 563 bp, Homo sapiens
  misc_feature: GYAE6OF02GITN5.51.83.H06.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (398)..(398): a, c, t, g, unknown or other
  misc_feature (398)..(398): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaangccaccctctcctgcagggccagtcagagtattaacngcgacttagcctggtaccagcagaacctggccaggcctccaggcctcctcatctatggtgcactccaccgagggccactggcatcccagccaggttcagtggctagtgggtctgggacagtacttcgctctcaccatcagcacgcctagacgtcctagaagtntttgactagtttattagttgtctagacacgacgaaactacgtacgtcccttcgttcgggtaccgtttcgggaccgtaacgggaccgtaagggtaggaactacgaaacgtaacgtaggtacgtacgtacgacctacgtactccgttacgttcttacgtacttcccg

SEQ ID NO: 102488 - DNA, 714 bp, Homo sapiens
  misc_feature: GYAE6OF02F9FZ1.51.83.H06.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactcgtggctcccagatgccaccggacaaattgtgttgacacagtctccagtcaccctgtctttgtctccgaggggaancgccaccctctcctgcagggccagtcagagttataacngcgacttagccgtaggtaccagacaagaaacccttgggacccaagggtcctaccccgacgggtccttacctacacttcctagtggggtcacgaactcccaccgacgggaccacgtcggacacgtcccgacgccgtaggtcgagtcggctaggtcgggtctggggacacggtacttcggacttcctacaccgtatcgacgtccaacgaccttaggaccgtaccgtagtaaacgttatttacggacttaaggttttatttaacgttcggtaactacgtacgtaacggaaccttaaacgtaccgttacggttaccctttaccgttacgggtacccggtttaccgggaacccggtaaacgggtaacccgtaacggggtaacggtaacgttaacccggaaaccggttaacggtaccgttcgggaccgttacggacctacccgttaagtccgtttacgttacgtttactaccgttaccccgg

SEQ ID NO: 102489 - DNA, 764 bp, Homo sapiens
  misc_feature: GYAE6OF02I08T3.51.83.H06.1.454.CMB.1.raw
  modified_base (197)..(197): a, c, t, g, unknown or other
  misc_feature (197)..(197): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctttgtctccaggggaanagccaccctctcctgcagggccagtcagagtataacagcgtacttagcctggtaccagacaaggaaaacctggacccaggccctaccccgagggtccctccctacatctatggatgacatcccgaacgaacggggcccaactgaactactccccgaggcctagggttcaggtcggacgtaggttcggggtcgttaggggactaaggtacgttaccgtaacgttccttacccgaacctacgttacccgaagggccctaaccggtcccgtaggacccacggtttaccgtaaggttaaacggtttagtttttacgaaccgttttaaactttttaacgtttaccgttaggtttacctaacggtaccgttaaagtttaaacgttaaacgttaaccggttaccgggttacccttaacccgggtttaaacttttacccgggtttttaccggaaacccgggtaacggggggttaaccctaagggtaccggttaagggtaacgttaacgtaaccggtaaaacggttaccggttaggtaccggtacgtaccgaccctaacgttacgttcgttaacgg

SEQ ID NO: 102490 - DNA, 669 bp, Homo sapiens
  misc_feature: GYAE6OF02H85PG.51.83.H06.1.454.CMB.1.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaanagccaccctctcctgcgagggccagtcagagtattaacagcgtacttagccgtcggtaccagacagaaacctgggccaggcctccgaggcctcctcatcctatggtnactactccacgacggcctacgtgacactcccgagccgtaggtacaggtcggcgtacggtgggtccgtagggactacggtacctttccgctccgtaccaacctacgtaccacgaccgaacgtcccgtaaggtaccggtacccgtaaggtaagttaacttttcggacttttaaaggttttatttaagttcgtacgagtcgtaacgaaccgtaaacctacgtcggtacccttaccggttacggtaccggttaccggaccggaaacggtaccggaagtacggaaacgtacgaaacgtaacggtacgggtacggacttacggacccttaacgacgtttccgtacgtttccttaccgtaccttaccccg

SEQ ID NO: 102491 - DNA, 597 bp, Homo sapiens
  misc_feature: GYAE6OF02H2HNS.51.83.H06.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgcccaaccggacaaatttgtgttgacacagtctccagtccaccctgtctttgtctcgaggggaaancgcccaccctctcctgcagggccagtcagagtataacagcgtacttagcctggtaccagcaagaacctggccaggcctcccaggcctcctctatctatggtncactccaccgagggccacgtggccactccccgagcccgtaggttcaggtcggctaggtgggtctagggacaggtacctcgctcnccaccatcgcacagcctagacgccgtagtaagtatttcgacttagtttattattgtacatcgagaccgaaacacgttcgtacccgttacgtacggtaccgttaccggacgtaacgggacccgtaagggtacgtaaacgtacgaaacgtaccgtacggtcggacgtagtaccgacctacgttccgtacgtttcttaccgtacttcccg

SEQ ID NO: 102492 - DNA, 710 bp, Homo sapiens
  misc_feature: GYAE6OF02I1ZJY.51.83.H06.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtcctccgagggggaanacgccaccctctcctgcagggccagtcagagtaattaacagcacttagcctaggtaccagcaagaaaccgtggaccaggcctcccaggctcctcatctatggtcncactccaaccgngggcctacgtggccactccgagtccgtaagttcaggtcgctagggtcgggtctggggactacggtactttccgacttccctacgaaccctagtcacgtactacgtacgtacggaccgccgttaagaaacgtttacgttttcgaacgttttagttttaacggtttaactttcgttaaccgtacgtacgtaacggtaaacccggtaaaactaaccggtttccggtaccctttaccgggtttcggtaaccgggtttcccggaacccggtaaaggggaacccttaaagggggtaccgtaaacgtaacgtaaaacccggtaagttaaccggtgggtaacctaccggtaccaaccggttacttaccgtcggttttaaccttcggaacgttttcccccg

SEQ ID NO: 102493 - DNA, 894 bp, Homo sapiens
  misc_feature: GYAE6OF02IDTJK.51.83.H06.1.454.CMB.1.raw
  modified_base (204)..(204): a, c, t, g, unknown or other
  misc_feature (204)..(204): n is a, c, g, or t
  modified_base (525)..(525): a, c, t, g, unknown or other
  misc_feature (525)..(525): n is a, c, g, or t
tcagcgatcgtatacacgaccggtgctcgatttagatcacgtgcgtcgcgggggaggaactgctcagttaggacccagaggaaccatggaagccccagctcagcttctcttcctcctgctactctggctccagatcgccacggacaaattgtgttagacacagtctccagtcaccctgtcttttgtcctaccgaagggggaaanacgccctaccccttctcctaggcacgggccaaggttcgaaaggtagttaaacttaaacgacgtaccgtaactttacggcccttcgggtaacccaggccgaaacggtaaaaaccccgttcggggaccccaaacgggggcccttacccccgaacggggtcccttaccccgtaccgtaacttccttaaagttccgggttgacccgtaacgttccccgaaacccggtaagggggcccccaacggttcggggacctaccgtaccccgaacggccccgtaacggggttttaccaacgggttcgggacgtaggttcggggttaaccgnggggaactaacggtaccgtttccggccttacttcccgaacccacttacccaagggtaccacggtaccgagtaccggcccgtttaaggaaacgttagttttccggaacttaacggttttaatttacgtttcgttacggaaggtaccgttaaacggaacccggtaaaacgtaacccgttaccggggttacccttacccggtttaggggttaaccgtttcccgggaaaacccggtaaacggggtaaaccgtaaacggggttaacggtaaaactaaccggtaaaacggtaacgttaacggttccgggtaaccgtttcgaacccgttacctaacgttccgtttaggtttaccccgtttataacccgttccccgg

SEQ ID NO: 102494 - DNA, 605 bp, Homo sapiens
  misc_feature: GYAE6OF02FOIRY.51.83.H06.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaanagccaccctctcctgcagggccagtcagagtaataccagacgacttagcctggtaccagcagaaacctggaccaggctccaggcctcctcatctatgtgcatccacagggccacgtgcacnccgagccagttcagtggcaggtggtcgagggacaggtacttcgctcgtacacctatcacgcacgcctagcgcctagaacgtagtttcactaattttaacgttactacgttacgagtactaagttaaacttaaactaaccgttcggaccttccgttaaccgttaccgttttaccgggacgtaaccggggtaaccaacggtacggtacgggtagtaacgtaacgaaaccgtaacgtcggtacggtaccttacggaacctaacccgttagtcgttccgttacgttacc

SEQ ID NO: 102495 - DNA, 643 bp, Homo sapiens
  misc_feature: GYAE6OF02JJV9K.51.83.H06.1.454.CMB.1.raw
  modified_base (198)..(198): a, c, t, g, unknown or other
  misc_feature (198)..(198): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgtctgtgtctccaggggaaanagccaccctctcctgcagggccagtcagagtgttagcagcgtactagcctggtaccagcaagaacctggccaggctcccgagctcctcatctatggatcgcactccaacgaacgggccaatcgattactcccaagtcccaaggttccagtcggcaggttgggtactaggggaacaggtacgtttcgaaccgttccttaccgacctacgtaccgaacgccgtacgcccgttcgccgtacggttaccttaggtaaacgttacgttttacgtaacttaaacttttacgtttaacttaggtacttaagtacgtagttaactaaagttaaccgtacgttacccttacgttaccgttacgttttacgggaccgtacgggaccgtaaggtccgtaagggacgtacgtaaccgaacgtaacgttcgtacggtacgtaccggtactaccgttac

SEQ ID NO: 102496 - DNA, 764 bp, Homo sapiens
  misc_feature: GYAE6OF02JVMIX.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgcccaccggacaaattgtgttgacacagtctccagtccaccctgtctttgtctcgagggaagacgcccacctctcctgccgtagggccaggtcaagtagttaacttaacgagacgtacgttacgccgtaggtacccagaccgtaacgaaacctcgggtacccacgggtacctaccccggaggacccttacctaccgaattccttacgtacgggtcgacctaccgtaccccgaaccggacgggtacctaccggttcggacctacgtaaccccgacggtaccccgtaagggtttccgaacggtcggagttacgggtcggggttccgtacgggaacctacggtaccgtttccgaccgttcctaaccgaacccgtagtaccgaacgccgtaacggtacccgtagtacggtaccgtacggtaacgtttaacgtttacggtaactttaacgtttactttacgttacggttacctacgtactaagttaacgttaaacgttaccgtacggttacccgttaccgttacgttaaccgtttcggaccggtacggtaacgtaccggtacgtaggtacgtaacgtaacgtaacgtacgtggttacgacgtacggtacctaactcgtactacgttccttac

SEQ ID NO: 102497 - DNA, 779 bp, Homo sapiens
  misc_feature: GYAE6OF02IK9N2.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaangccaccctctcctgcagggccagtcagagtaattaacagcgattgcctggtaccagcacgaaacctggccaggcctcccgagtcctcctcactctagtcggtgcatcccgaccgacgggcctacgtggcctactcccgacgaccaggtttacgacggttggaccgtagggtcgggttacgtagggtactacggtaccttcggaccttaccgtacctaacccgtactaccgacgtacctaacggtacccgtaacgacggtaccgttaaggtaaacgttacgtttacggtaccgttaagttttaacgttacgttttacggtactaacgggtaccgtaacggtaaccggaaaactaacccggtcgggttaaccccttaccggtttacgggacccgggttttaccgggaacccggtaaacggggtaaccccggttaaaggggttaaacgggaaccgtttaaacccggaaaccgggtttaaccgttaccggggttaaccgggttaccgtaacccggtaacccgtttaccgaaccgtttttacgtacccggttttaaccgttccggttaacccgtttacccccgg

SEQ ID NO: 102498 - DNA, 794 bp, Homo sapiens
  misc_feature: GYAE6OF02HO0FC.51.83.H06.1.454.CMB.1.raw
  modified_base (239)..(239): a, c, t, g, unknown or other
  misc_feature (239)..(239): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaagagcccaccctctcctgcagggccagtcagagtattaacngcgacttagcctggtaccagcaacgaaactcggccaggcctcccaggcctcctcattctatggtcgcacgtccaaccgacggaccacgtcggaccactcccgacgaccgtacggttccgaggtacggtcgtaacggttcggggtcggtagggacctaaggtacccgtttcggctttacccttaccgaaccctaactccgtaacggacccgtaacggtacccgtttaacgggaaccggttccccgtttaagggtaaaacgggtttaacgtttttacggaccgttttaaagttttttaactttaagttttcggtaaccgttaacgacgttaacgaacccgttaaaaccggtaccgttaccggtaccccgtttaccggtttacgggtacccgtttaccgggtaaaccccggaaacggggtaaacccggttaaagggtaacggtaaaacccgttaccgaaaacgggtaaccgtttacgggtacgggtaccgttaaccggacccgttaacccgaacgttccggtttaacccggtttataccccgtttaatttccccccgg

SEQ ID NO: 102499 - DNA, 863 bp, Homo sapiens
  misc_feature: GYAE6OF02IPBJ0.51.83.H06.1.454.CMB.1.raw
  modified_base (280)..(280): a, c, t, g, unknown or other
  misc_feature (280)..(280): n is a, c, g, or t
tcagcgatcgtatacacgaccggtgctcgatttagatcacgtgcgtacggacggggggaggggaacgtcgcgtcgagttaggaacccaggaggggaaccatggaacgccccaggcctcgagccttctcttcctccctcgctactctggctccagatcgccaccgggacaaactttcggtagttgacactagtacctcccagtccacccttggttctttgtcgtccgaggggaaacgacgacccacccgtctcctaggcacgggccagtcagagtataacngacgtacttacgacctaggtaccagcaacgaaacctgggaccccgaggcctaccggacggccctccgtccacgttccttagtcgggttgacttacttacccgaacggtacgggtaccaccggtacggccctaccgtacccggacgccggtaggttaccgacggttcggtacgtagggttccggggtcgtaacggggactacggtaccgttaccgacttcctaccacccgtactacccgacggccgtacggtaccgtacgggaccgtaccgtaagggtaaacttacggtttacggtaccgttttaagttttacttttaaacgttcggttaacccgtaggtacccggtacgtaaacccgaaaaccgtaccggttaccgggttaccccggtttaccgggtttaacggggttaaacccgttttaccggggggaaacccgttaacgggggttaaacccggtaacggggtaaaccggtacggtaaacccggtaaaccggggttccgttacggggacccgggttcctaacgggacccttacccgttaccgttcccggtacggtttaccccgttccctacccgttcccccg

SEQ ID NO: 102500 - DNA, 554 bp, Homo sapiens
  misc_feature: GYAE6OF02GSCPO.51.83.H06.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaanagccaccctctcctgcagggccagtcagagtattaacagcgacttagcctggtaccagcagaaacctggccaggctcccaggcctctcatctatggtncatccaaccgagggccacgtggacatcccagccaggttcaggtgcagtgggtctgggacaggtacttcgctctcacatcgagcacgccgtagacgcctaggaagtatttcgactagtttattattgtcagcagacgaaactacgtcggcctcgttggacgttcggaccgtaacgggtaaccgaaggtacggaactaccgaaacgtaacgtggtacggactagaccaacgtacttactcgttacttaccgacttcccg

SEQ ID NO: 102501 - DNA, 640 bp, Homo sapiens
  misc_feature: GYAE6OF02HEPPF.51.83.H06.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaggggaaangcccaccctctcctgcagggccagtcagagtataacngcgacttagcctggtaccagccaagaaacctggccaggcctccgaggcctcctcatctatggnctactccaccgagggccacgtcggcactccccgaagcccgtaggttcaggtcggtacgtaggtgggtaccgtagggacaacgtcttcgctctacaccatcgagcacgacctaggcgtcctagtaagttgtttacgactttaagttttatttacttgtacgtagtacgtacgaaccgtaaacgtacgttccggtaccctttacggttacggtaaccggtttccgggaaccgtaaacggggaccgtaaaggggtaacgtaactaacggtaaaccggtacgttcggtacggtccgtagaaccgtacctacgtaccgttacgtaccgtttacaccgtttcccg

SEQ ID NO: 102502 - DNA, 849 bp, Homo sapiens
  misc_feature: GYAE6OF02GPWHT.51.83.H06.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (411)..(411): a, c, t, g, unknown or other
  misc_feature (411)..(411): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgcccacggactaaattgtgttgacacagtctccagtcacccttgtctttgtctccgaaggggaaanacgcccaccctctctcgcacgggccagtcagagtataacagcgtactagcctggaccngacgaagaaacccgtggaccgaggccttaccccgacggtccttccctactacttaccgttaagttcggtcgaccacgtacccgaacccgtacgggccccaagtccgggacctaccgtacccgacggtacccgtaacggttcgacggtcggngtacggttgggtccgtaggggacctacggtccttacggtccctacctacgtacccaagtccgtacgaccgtaaccggcgtttaacgggacgtaacccgtttaggtaaacggtttactttaccggtaacgtttttaacgttttaacggtttcgtttaccgggtactaacccgggtacgggaaacttaacccggtaaaaacgttacccgggttaaccgggttccccctttttacgggaaccgggggtttacccggtttaccggggaaaccccgggtttaaaaaccgggtaaacgggtaaccggggttaaaagaaaacccgtttaccggaaaacccgggtttaaggttaccgggtacgggttaaccctacgtaaacccggtttacccgaacgtttttacccgtacgttttaacccgttcgttaccccggtttaccccccgg

SEQ ID NO: 102503 - DNA, 878 bp, Homo sapiens
  misc_feature: GYAE6OF02HXVCX.51.83.H06.1.454.CMB.1.raw
tcagcgatcgtatacacgaccggtgctcgatttagatcacgtgcgtcgcgggggaggaactgctcagttaggacccagagggaaccatggaagcccagctcagcttctcttcctcctgctactctgcctccagatgccaaccggactaaattggtgttgacctacagttctccagtccacccttgttctttcgtcctaccgaaggggaaacgcgcccacctctccgtcgcgacgggcctagtcgaagtagttaacttaaacgacgacgtacttacgctacggaaccagctaaacggaacctggaccgaacgggtcctacccgaggtcccttccgactacttacgtacggtcggtctacctaccgttacccaaccggtacgggacccctaacggttccggaccaacccgttacccggaacggttacccccggaaagggtttccggaacggttcgggaaccggttacggggtcggggtacgtacggggtaacacgggttacccgtttacggccctttaccgtaaccgacccgttaacgtccggacgggtaaccccgccggtaacccgtttaaccgggtacccggtccgtaaacggttaaacggtttaggttttaccggaacgtttttaacggtttagtttaacttttcggaccgttacggtaactaacggtaaccgtaaaaccgtacgtttacccgggtacccgttttaccggtaacgggttaccggtttacgggaaaccccggtaaaggggaaacccgttaaaggggtaacgaaaacggttacccgaaacggttaaacccgttgggttacggaacccgtaacggaccgtacctttaacggtacccggtttaatttcccgttaacttcccttaaccccgg

SEQ ID NO: 102504 - DNA, 790 bp, Homo sapiens
  misc_feature: GYAE6OF02I133J.51.83.H06.1.454.CMB.1.raw
  modified_base (196)..(196): a, c, t, g, unknown or other
  misc_feature (196)..(196): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagatgccaccggacaaattgtgttgacacagtctccagtcacctgtctttgctcgagggaangccacctctcctgcgagggccagtcagacgtattaacagcgacttagcctggtaccagcagaaacctggccaggctcccaggctcctcatctatggtcgcatcccaccgagggccacgtcggactacctccgacgccgtaggttccaaggttcggacgtaggttcgggtacgtcggggaactacggtacttacggaccttccgtaccgaacctaattccgaacgtccgaagtacccgtaaggacgtaccgtagtaaacgttgttttacggacgtttaagttttacgttaagtttccggttacgtaacggtacgtaaacgggtaacccgtaaaaaccgttaccggttaccggttaccccgtttaacccgggttttcggggtaaacccgggttttaccccgggaaacccgggtaaaccgggggttaaacccgtaaaaggggttttaaccgggaaaaccgttttaacccggaaaaaacccgggttaaccggtttacggggtaaccgggttaacccgttacgggtaacccgtaacccgttaacggtttacccgttacgggttttaccctttaccggtacccgttttaacccccccggg

SEQ ID NO: 102505 - DNA, 640 bp, Homo sapiens
  misc_feature: GYAE6OF02FGEUU.51.83.H06.1.454.CMB.1.raw
  modified_base (244)..(244): a, c, t, g, unknown or other
  misc_feature (244)..(244): n is a, c, g, or t
  modified_base (309)..(309): a, c, t, g, unknown or other
  misc_feature (309)..(309): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccacccttgtctttgtcctccgaagggggaaagacgcccaaccctctcctgcagggccagtcagatataacngcgattagcctgtaccagcacgaaccgtggccaggcctcccgaggcctcctcactctagtggtcncactcccacgacgggccacgtcggcacgtcccagtccgtaggttcaggtgcgaggtggtcgtgggacagtcttcgctcacaccatcagtcagcctagacgtcgtagaagttgtttacgcttagttttattattacgtactacgcgtaacgaccgtaaacgtaacgtcgtacccgttaccgttacgggtaccggtttaccggaacccggtaaacgggtaccgaaacggggttaacggtaactaaaccggaaaccggtaacgttcgggtacggtccttaccggaaccgtacccgtacgttaccgttcggtttccttaccgtacgtttaccccg

SEQ ID NO: 102506 - DNA, 732 bp, Homo sapiens
  misc_feature: GYAE6OF02F51N1.51.83.H06.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (442)..(442): a, c, t, g, unknown or other
  misc_feature (442)..(442): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgctccagggaangccacctctcctgcaggccagtcagagtataacngcgattagcctggtaccngcagaaacctgcaggctacccagctctcactctatcggtcnctactccgaaccgtagggcccaacgtcggacctaactccccgtaggaccccgtaagggtttccaaacgggttcggtacgtacggtttcgggtccgttaggggaacccacgggttaccttaccggtacccttaccgttacccaaccgtttaacnccgtacgacccgtaacggtaccctaaggaccgtaccgttaggaaacggttacttttacggacgtttaaacggttttatttaacgttacgttacgtaacgtcgaacggtaccgtaaaaacgtaccgttacggtaccccttaccgtttacggtaacccggttttcgggaaacccgttaaaggacccgtaaagggtaacggtaacgtaaccgtaaacggtaaccggttaacgtacggtaaccgcgtaaccctacgtacgttccgtacgtttaacttaccgtactttaccccgg

SEQ ID NO: 102507 - DNA, 723 bp, Homo sapiens
  misc_feature: GYAE6OF02JY14N.51.83.H06.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
tcagcgatcgtatacacgaccggtgctcgatttagatcacgtgcgtcgcgggggaggaactgctcagttaggacccagagggaaccatggaagccccagctcagcttctctcctctgctactctggctccagatgccaccggacaattgtgtgacacngtctcagtcaccctgtcttgtctccgaggggaagcgccacctntccgtagcgacgggccagtcagtagtataacggcgacttacgctagtaccagcaacgaaccgtggaccacggcctccccgaggtcctcctctaagtctaacgtcgaagtcgactaaccgtaccaaccggaacggggaccctacgtacgtacttaccgaccccgtaggtccgtaagggttcacggtccgggtaatacgggttaggggtaccgttaggggtaacgtacggttaccgtttcgaacccgttcgttaacccgaaccgtacgttacgaccggtacctacgggtacccgtacgtaccgtacggttaccgtacggttaaaacgtttcgtttttacggaacgtttaaaggtttttaccttaaacggttcggttacgtaacggttactaacggttaaacgttaagttaaacggtccgttacccgttacgttaaccgttcgtttaccggacgggtacgtaacgtagtcggtacgagtacgtacgaacgtacgttgacgtcgtacgtcctacgtcgtacttcgg

SEQ ID NO: 102508 - DNA, 709 bp, Homo sapiens
  misc_feature: GYAE6OF02JWMIK.51.83.H06.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctccagatgccaccggacaaattgtgtgacacagtctccagtcacctgtctttgctcgagggaangccacctncctgcagggccagtcaggtatattaacngcgacttagcctggaccagcagaacctggaccaggcctccgaggtcctacctcgactctaagtcgggtcacactccaacgtcgggcctaacgtcggacctaacgttcccaaggtcctaagggttaccaggtcggactagggtgggccgtaagggactaagggtccttcggactttccaccgaccgtatccgagaccgaacgaccgtaggacgaccttaggtaaacgttagtttagacttaaggttttaacgttcgtttacggttacaacgtacgaacggtaaaccgtaaacctaacgtccggttaccgtttacccgggttaacgggttaacccggtttaccgggaaccgggttaaaccgggaaccgtaacgggggttaacgtaaacgtaaccggtaaaacggtaaccggtttggaacggtcgtaaccggttaccaaccgttacgtacgttacggttaccttaccgttaccgttaccccg

SEQ ID NO: 102509 - DNA, 761 bp, Homo sapiens
  misc_feature: GYAE6OF02HCLY0.51.83.H06.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggactaaagttgtgttgacacagtcctccagtcaccctgtctttgtctccgaggggaaagagccaccctctctgcgagggccagtcagagtataacagcgacttgcctggtaccagcagaaacctggccaggctcccgnggctcctcnctctagtggtcgcactacccgaccgacgggcccaacgtcggactaccgtcccgagtacccgtaggttaccgaggtacggaccgtacggggtggggttaccggttacggggaacgtaacggtccgtttacggtcccgttacccgttaccctaaccctagttaccgaccggaccgtacggacccggttaacggaaccggttacccgtaaagggttaaatttaccgtttttggtaacctttaggtttttaacgtttacgttttcggtactaaggtaccgtaaggaacccggtaaaactacccggttacggaccccgttttccggttaacgggtacccggttacccggggaaccggtaaccgggaaacccggttaaggggttaaccggaaaccgtaccggtaaaacggtacgtcggtacgggtacctacggaccgaacttacgtccttaggtaccctttactacgttcccccgg

SEQ ID NO: 102510 - DNA, 640 bp, Homo sapiens
  misc_feature: GYAE6OF02FS64I.51.83.H06.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
tcagcgatcgtatacacgaccggtgctcgatttagatcacgtgcgtcggcggggaggaactgctcagttaggacccagagggaaccatggaagccccagctcagcttctcttcctcctgctactctggctcccagactgccaccggacaaattcgtcgttgacgacagtctccagtcacctgtactttgctcagggaaangccaccgtctccgtgcgagggccagtcacgtagtataaccagcgacttagcctggtaccagcagaacctgccagctccagctctnatctatcggtgcatccacgagggccacgtggcatcccagccctaggtcagtcggacaggttcggtcnggggactaggacttcggctcgtacgactactcgagtcacgtcctaagacgcctagaacgtactttggcctaaggttttactactttacgtacacgtacgtactaaccgtaaactacgtagggtacccttacgttcggtaaccggtttacgggacccgtaaaggggaaccccgtaagggttacggaaacgttaccgaaacgggtaaccttacgggttacgggtaacctttaccggaccgttaaccgtactttacccggtagtttacccgtttacgacgttttaaccccg

SEQ ID NO: 102511 - DNA, 707 bp, Homo sapiens
  misc_feature: GYAE6OF02HD4MB.51.83.H06.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (399)..(399): a, c, t, g, unknown or other
  misc_feature (399)..(399): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccgganaaattgtgttgacacagtctccagtcaccctgtctttgctcgaggggaaancgcccacctctcctgcagggccagtcagagtactaacagcgaacttagcctggtaccagcaagaaacctggccaggctaccagctccncatctanggtncatccgaacngggccactggaccacgtcccaagccgtaaggttcaacgtcggacgtaggttgggtcctagggggacaggtaccttcgctacgtaccaacctancgaacggtcagacctaggacgtccgtaggtaaacgttagttttagaccttaaagtttttacttaacgttttagttacgaaaccggtcgaacggtaaccgtaaaaaccgtacgttacgggtaccccgtttaccgttacggggttaaccggtttccggggaacccgaaaaggggaaccccgtaaagggggttaacggaaaaccttaaccggtaaaaaccggaacgtttaagggtaccgggtaacgtaccggtacccgaaacccgttacgttaccgttaccggttaccctttaccgtaacgtttacccccg

SEQ ID NO: 102512 - DNA, 729 bp, Homo sapiens
  misc_feature: GYAE6OF02IGKWX.51.83.H06.1.454.CMB.1.raw
  modified_base (178)..(178): a, c, t, g, unknown or other
  misc_feature (178)..(178): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggacaaagttgtgttgacacagtctccagtccnccctgttctttgtcctcgaaggggaagcgccctaccctctccgagcgacggacctagtcagtagtaactaacgacgacgtacttacgcgtacggtaccacggacaagaaccgtcggaccgacggtcctacccgaggtcctccgtacactaccgttaggtcggtcaccgtaccgtacccgaaccggcggtcctacgtcggacctaccgtccccgaacggtcccgtaagggttccgtaggtaccggtcggtacgggttcggggtacgtacgggaacggtacgttaccgtttccggacctccgttaccaaccgtgtccgacgcgtaccgactaacgggtcgtaccgttagttaacgttgtttacgacgttttaagtttatttacttggacgtacgacacggtaacgtaaactcgtcggttacccgtacggttacggtaccggttaccggaaccggaaaagggttccggtaaaacgtaaggtacctaccgtaaaggtacgtgtacggtaccaggacctacgtacgttcctcggttaacctccgtaccgttacccg

SEQ ID NO: 102513 - DNA, 860 bp, Homo sapiens
  misc_feature: GYAE6OF02F5JO5.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaggggaaangccacctctcctgcagggccagtcagagtataacagcgacttaggcctaggtaccagacaaggaaacctggaccaggcctcccgaggcctccgtactactcgtaagtcgggtcgccaacgttaccccgaaccggacggggccctaacggtcggacctacgtccccgagtcccgtagggttcacgggttcggacgtaggggtcggggtacgtacgggggaacctacggttaccgttccgcccttaccgtacccgacctaacgtaccgacggtcccgaacggtcccgtaaggacggtaccgtaaggtaacgtttacgttttcggaacgttttaacggtttttaatttacgtttcggttaccgtaacggtacgtaaaccggtaaaccggtaaaactaaacccgggttccgggtttaccccgtttaaccgggtttaccgggggtttaacccggttacccgggggtaaaccccggtaaaacgggggttaaacccggttaaacgggggttaaaccggttaaaaccggttaacccggtaaaaaaccgggtttaacgggttaccgggttaaccggggttaccttaacccgggtaacccgttaaaccggtttacggttaaccccggttttaggttacccccttttaacggtacccgttttaccccccgg

SEQ ID NO: 102514 - DNA, 831 bp, Homo sapiens
  misc_feature: GYAE6OF02IKYUL.51.83.H06.1.454.CMB.1.raw
  modified_base (179)..(179): a, c, t, g, unknown or other
  misc_feature (179)..(179): n is a, c, g, or t
  modified_base (452)..(452): a, c, t, g, unknown or other
  misc_feature (452)..(452): n is a, c, g, or t
tcagcgatcgtatacacgaccggtgctcgatttagatcacgtgcgtcgcgggggaggaactgctcagttaggacccagagggaaccagtggaagccccagctcagcttctcttcctcctgcctactctggcctccgagatcgccaccggtacaaattggtgttcgacactagtctaccngtccaccctgttctttcgctccgaagggaagcgtcctacctctcgtcgacgacggtccagtccagagttaactaacgagaccgtaacttcggtccgttacgaacgacgacgtaacgtaaaccggtcgacgtaaccggcctacccgagtcctacctaccgtagtacccgttgtcggttaacacgaccgtacccgaccggtaaccgcccgttaaccggcgacctaaccgccgtaacgaccggttaacggttacgaacggttcggacgttaacggngggttaaccgacgggttaacaacggttaactttccgacctcccgtaactaaccggacttacgacccggaatacggttaacccgtacggaaccgtcgtaacggttaaccgtttagtttaccgaccgttttaagtttacgtttaagttccggttaaggacttaagaaccggtaaccgtaaaccgttaacggttaccgtccccggtttaaagttaccggggtaacccgtttaccggaacccgggaaaacgggttttaaccgaagggtttaaaacccggaacgtttaaaaccgaccggggttttaacaacggttccgggttaaccgacgttacccgacgtaaccgttccgtttaacgggtctttaccaccctttaaccccggg

SEQ ID NO: 102515 - DNA, 761 bp, Homo sapiens
  misc_feature: GYAE6OF02ICKQZ.51.83.H06.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
tcagcgatcgtatacacgaccggtgctcgatttagatcacgtgcgtcgcgggggagaactgctcagttaggacccagagggaaccatggaagccccagctcagcttctcttcctcctgctactctggctccagatgccacggacaaattgtgttgacacagtctccagtcacctgtctttgtctccaggggaangccacctntccngcagggcagtcagngtataacngacgacttgcctggtacagcaagaaaccgtggaccaggtcctccaggcctacctctacgtctagtcgggtacacaacttccgaaccgtacgggaccccaggtccggactaaccgtcccaggaccccgtagggttacacggtacggtcccgaaggttcggggtctacggggactacggaaccgtttccgacttacccgtacgaactacgttaccagaccgtaacgtccccgtaaggtacgacccgttaggtaaacgttacgtttaacggctttaacggttttaaactttagtttacgtacgaacggtactaaacggaaccgtaaaaccgtacgttaccggtcccttaacggtttacgggtaccgttttaaccgggaaccgggtaaacgggtaaaccgtaaaggggttaacggaaaacccgttaacggaaaaccggttaaacggttacgggtaacggtaccgttaacggaccccgttaaccgtaacggttacccgtttaacgggttttacctttacccggattttaaccccccgg

SEQ ID NO: 102516 - DNA, 711 bp, Homo sapiens
  misc_feature: GYAE6OF02JYPLG.51.83.H06.1.454.CMB.1.raw
  modified_base (200)..(200): a, c, t, g, unknown or other
  misc_feature (200)..(200): n is a, c, g, or t
  modified_base (442)..(442): a, c, t, g, unknown or other
  misc_feature (442)..(442): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctcgaggggaaancgccaccctctcctgcgagggccagtccagacgttaattaacgagcgactttaggccttgggtaaccaggcacgaaacctggaccacgggcctacccgaggcctcctctactccttagtgggtacactactcccaccgacgggccctaacgtcgctactacccgagtacccgtaggttcacggtcggacctaggttcgggtcgtagggacctaggtaaccttcggcttacctccaacgtacnccgtaagcgtacgaccgttacgagtcccgtaggtaacgtttacgtttacgtcgttaaggttttaacttacttttaggtacctacggtaaccgtaaggaacctaaacgtaaccggtcggttacccctttaggtacgggttaccgttaccgggaaaccggtaacgggtaaccgtaagggtaaccgaaggtacgtaaaccggtaggtacggtacgtacgtaccgtaaccgaccgttacgtctttaccgttaccgttactacccggttacccg

SEQ ID NO: 102517 - DNA, 892 bp, Homo sapiens
  misc_feature: GYAE6OF02HU2PH.51.83.H06.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtccaccctgttctttgtctccgaggggaaagngacccaccctctcctgcgacgggccagtcagataattaacngccgacttagcctggtaaccagcaacgaaacctggccacggtctcccgaggcctccgtcattcctaagtcggtagtccgacttacccgaacccgacgggccctacgttcgggcctaacgtaccccgaacgggtccctaagggtttaccgacgggtacggtcgtaacgggttcggggttccgaacgggtaaccgtacggttaccctttaccgggaccctttaccgtacccgtaacccgtaaacgtcccgtaacggtaaccggtaccggttaacccgtaaaccgggtaaccggtaccccgttaagggttaaaacgttaaccggtttttacgttaaccgggttttaaagtttttaacgttttaaaccgttttagttacccgtaacgtaacggttaaacggaaacccgtaaaaccggttaacccggttaaccgggttccccccggtttaacgggttcccggggttaaccccgggttttaacccggggaaccgggttaaaccgggaaaccggttaacgggaaacgggttaaaccgaaacccggttaaaaccggtaacgggttacggttaacgggtacctaaccggtaccctaaaccgttacgttacccggttaccggtttaacccgtttacgtaacccggttttccccccgg

SEQ ID NO: 102518 - DNA, 673 bp, Homo sapiens
  misc_feature: GYAE6OF02J1DCW.51.83.H06.1.454.CMB.1.raw
  modified_base (213)..(213): a, c, t, g, unknown or other
  misc_feature (213)..(213): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgcctactctggctcccagatgccaccggacaaattggtgttgactacgagtctaccagtccacccgttgtctttagtcctccgaaggggaaacncgcccacccttctccgtcgcgacggtccagtcgacgagttaactacgagcgtacttacgcctcggtaaccagacaacgaacctggacccaggtcctaccggagtcctccgtacacttcgtacggtggcgacctaacgtcccaaccggtacggcctacgnggtaccactccgacgtcgtaggtccaggtcgcnggtcgtcgtaggctagtcttcgctacgtccacgtatcgacgcacgtaccgtaagacgtaccgtagtaacgtacgttcgtaacgttacgtttacgttagttacgtacgtagtacgtaacgtaccgtaaacgtacgtacggttaccgttaccggtaccgttaccggttacggaaccggtaacggtaacgtaggttaacgaccgaacgtaacggtaacgttggacgcgtacaccgtacctagttacctcggttactccgttaccgtacccg

SEQ ID NO: 102519 - DNA, 827 bp, Homo sapiens
  misc_feature: GYAE6OF02F99AA.51.83.H06.1.454.CMB.1.raw
  modified_base (172)..(172): a, c, t, g, unknown or other
  misc_feature (172)..(172): n is a, c, g, or t
tcagcgatcgtatacacgaccggtgctcgatttagatcacgtgcgtcgcgggggaggaacgtgctcagttaggacccagaggaaccatggaagcccagctcagctctcttctcctgctactctgctccagatcgccaccggactaaattgtgttgacacagtctccacgtcnccctgttctttcgtcttaccacggggtaaggactccacctaccgtcctgcgacggacccgattacgcgaagttacgtaaacgacggacgtaacccgtttagtccccgtaggtttaaccccgacggtacaacggaaaaacccgttggaccccggaagaccccgtttaccccgaacgggtccgtttacccctacgtacttaacgtccgttaacggttcggaaccctcttaccccgaacccgtacggggacctaaccggttcggcgtaactaccccaacggccgtaccggttacgttacgacgggtctaggggtcggtacggtacgggaacggtacggaaccttcgtcgtacccgtaccgtacccgaactttcgacgtacgaacgtcgacgtaccggtctacggaacgttacgtttacgaccgttaatttacgtttaaccgttatttacgtactacggaaccgtaacgaaacgttaaccgtaacgtccgtttccgtttacggtaccggttaccggtccggaaaccggttaaaccggacgggttaaacggttaccgtaaacggttaaaccgtaacggaaccgggtttcggtaccgaacggttaccgtaccccgtaacgtttccgtaacgttacgggttttacctacgtttaaccccggg

SEQ ID NO: 102520 - DNA, 602 bp, Homo sapiens
  misc_feature: GYAE6OF02JE7IP.51.83.H06.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (553)..(553): a, c, t, g, unknown or other
  misc_feature (553)..(553): n is a, c, g, or t
  modified_base (563)..(563): a, c, t, g, unknown or other
  misc_feature (563)..(563): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
tcagcgatcgtatacacgaccggtgctcgatttagatcacgtgcgtcgcgggggaggaactgctcagtaggacccagagggaaccatggaagccccagctcagcttctcgttcctcctgctactctggctccagatgccaccggacaaattgtgttgacacagtctccagtcaccctgtctttgactccgaggggaancgccaccctctccgtgcgaggccagtcagagtactaacngcgacttagcctggtaccngacagaacctggaccaggtcctcccgaggccctcctacatcgtatggtcncactccacggaggcccagtcgcacnccgagccgaggttcagtcggactggtcgggtacnggggactaacgtcgttccgaccttctaccacgacttacggacctcgacgccgtacggacgccgttaagtaaagttctttacgaactttaggttttaacttagtttacgcgtaaccgcgttaacgaaccggtaactaaccggtcgtaccgtacgtacggtcgttaccgacgtaaacggcgtaaggcaanacgaaccgtntggtacntcgacacngtccgtactccgtatacccttccg

SEQ ID NO: 102521 - DNA, 618 bp, Homo sapiens
  misc_feature: GYAE6OF02FJW1Q.51.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
tcagcgatcgtatacacgaccggtgctcgatttagatcacgtgcgtcgcgggggaggaactgctcagttaggaccccagagggaaccatggaagccccagctcagcttctcttcctcctgctactctggctcccagatgccaccggacaaattgtgttgacacagtctccagtcaccctgtctttgtctcgaggggaaangcccacctctcctgcagggccagtcagagtataacngcgacttagccctggtaccagcagaaacctggccaggctcccaggctcctcatctatggtncatccacacgggccactggcatcccagccaggttccagtggcagtgggtctgggacagtactcgctctccactatcacgcgacgcctagacgtcctagaacgtactttagacgtagttttagtttattcgttacagtcgtacggaccgaaactaacgttcgggaccctttaccgttagggtacccggtttaccgggtacccgaaacgggaccgtaacgggtacggggtaactaaccggtaaaacggtaaccgtacggtacgggtcgtacgacccgtaaccctacgttaccgttcgttaccgttacgtacgtttacccccgg

SEQ ID NO: 102522 - DNA, 720 bp, Homo sapiens
  misc_feature: GYAE6OF02JHJD7.51.83.H06.1.454.CMB.1.raw
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
tcagcgatcgtatacacgaccggtgctcgatttagatcacgtgcgtcgcggggaggaactgctcagttaggacccagagggaaccatggaagccccagctcagcttctcttcctcctgctactctgctcccagatgccaccggacaaattgtgttgacacagtctccagtccaccctgtctttgtctccgaggggaacacgcccacctctcctgcagggccagtcagatatacagcacttancctggtaccagcaagtaaccnggaccaggctcccaggcctcctcatctatggtgcacgtccacgagggccacgtgaccactccagtcctacggttcaggtcggaccgtaggttcgggtacgtgggaaccagtaccgttcgcgtccttcgacctagtcacgtccacgtaccgtagaccgtccgtagtaaacgtttacgtttcggaactttacgtttatttacggttcgtaacgtacggtacgtaaccgtaaccgtaaaaccggtacgttaccgggtaccccgtttccggtttaacggggtacccgttttaaccgggaaccccggtaaacgggtaaacccgtaaggggttaaaccgaaagtttaaaccccgtaaaccggggtaaactttccgggtacgggtttaacccgaccggttaaccgtacccgttacgttaacccggtacggttttaacctttaccggtaaccctttaccccgggg

SEQ ID NO: 102523 - DNA, 806 bp, Homo sapiens
  misc_feature: GYAE6OF02ILHDM.51.83.H06.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccaggagggaaccatggaagccccagctcagcttctcttcctcctgctactctggctcccagatgcccaccggacaaattgtgttgacangtctccagtcaccctgtcttgcctccgaaggggaancgtccaccctctccgtagcgacgggcccaggtcctaaggtacggttcggttaagccaaggccggtaaccttttacgtccgttacgggtaacccacgtaccgaacgtaaaccgtcgggaccgacggccttaccccgaggtccctcctccgtaattccctattagagttcgctaactcccgaaacgtacgggaccctacgtacgaattccgacccgaacgtcctaacggttacgtcgttacggtacggtacggttacggggttcgacggggtaaccttaaggacggtttaacccgtaaccggttcccttaccgaaccctacgttaccggacgacccgtacggtccgtaccgtacgtacctacggttaccggtaagtttaacgtttacgttaaccgttaatttaacttacgttacgtactaaccggtataaacggttaaacttaagtaccgttaccgtaccttaccgggtttactaaacggttttcccggaacgggtaccggtaaccgtacggtaacggtaacggtaacttaaaccggtaacgttaaacccggttaccggtaacgggtcggttaaccgtaccggtaaccgacccgttacggtttaaccg

SEQ ID NO: 102524 - DNA, 773 bp, Homo sapiens
  misc_feature: GYAE6OF02H9136.51.83.H06.1.454.CMB.1.raw
  modified_base (422)..(422): a, c, t, g, unknown or other
  misc_feature (422)..(422): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtcaccctgttctttgtcctccgaaggggaaagcgcccaccctctcctgccgacgggccagtacaggtagtattaaacaggccgtaacttacggcctcgggtaaccagacgaagaaaacccgtcggacccgacggtcctacccgacgggtcctcctctatcttagtcggtgcctactcccgaccgacggtccacgtggacctactcccagccgtaggttcacggtcggacgtaggttcgggtcgtaggggacngtacgttcgaccttacctaccgacctacgtcaacgtcgaccgaccgtaacgacggtaccgtagtaaacggtttatttacggtactttaacgttttacttttaagttcggtacgtaagtaccgtaacggtaaaccgtaaaaccgtaacgttaccgggttacccgttttacccgggttacggggttaacccggttacccggggtaaacccgggaaacggggaaaccccggttaaagggggtaaacggtaaacccgttaaacggtaaacccggtaacgtccgggttaaccgggtacctaccggaacccgttaccgaactttccgtagttaccgtttaccgtacctttaccccgg

SEQ ID NO: 102525 - DNA, 619 bp, Homo sapiens
  misc_feature: GYAE6OF02GGTSN.51.83.H06.1.454.CMB.1.raw
  modified_base (200)..(200): a, c, t, g, unknown or other
  misc_feature (200)..(200): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagngccaccctctcctgcagggccagtcagagtataacagcgacttagcctggtaccagcaagaaacctggccaggcctcccaggccctcctcacttctagtggtcgcactcccgaccgagggccacgtcggcacgtccccacgtccgtaaggttcgaggtcggcaggttgggtcctagggactagtacttcgcttctacacctactcagcagtcctagacgtcctagaagttagtttgacttagtttattagttcgtacagctagaccgaaactactcgggtacccttccggttaggtaccggttacgggaccaaacggggtaccgaagggttacgtaacgtaccgaaaacggtacgttacgggtacggtacctacggacctacctacggttccgtacgttccttaccgtaccttaccccg

SEQ ID NO: 102526 - DNA, 860 bp, Homo sapiens
  misc_feature: GYAE6OF02G1OGC.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaaggggaaagcgcccaccctctcctgcgagggccagtcagagtataacagcgacttagcctaggtaccagacaacgaaaccgtgggacctacggacctacccgaggtccctcctacattacgtaatgggtacgcgtactaccccgaaccgacggggacccctacgttacgggacctaacccttacccccgaacggtaccccgtaaaggggttccgaacggggttacgggtaccgtaacggggttcggggggttaaccgtacgggggaaacttaaacgggtaaacctttaccctaacccgttaccgttaacccgaacccttaaccttaacccgtaaaccccggaaacggtaaacccgtaaaggtaaccccgtaacccgttaaacgggtaaaggttttaacgtttttaccggggaaacttttaaacgggttttaaaccttttaaccgttacgggtaacccgtaacgggtccgttaaacggtaaacccgggtttaaaactaaccgggttaacgggttccctttaccggttacggtttaccggggaacggggtaaccggggtaaaccgtaaggggtacgaacgtaacgttaaccgaaacggttacgtgggtaacggtcctaggtaaccctactacgtttcgacgttactttaccgactttccccgtaacccg

SEQ ID NO: 102527 - DNA, 770 bp, Homo sapiens
  misc_feature: GYAE6OF02IRL7E.51.83.H06.1.454.CMB.1.raw
  modified_base (199)..(200): a, c, t, g, unknown or other
  misc_feature (199)..(200): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcgcgggggaggaactgctcagttaggacccagagggaccatggaagccccagctcagcttctcttcctcctgcttactctggctcccagatgccaccggacaaattgtgttgacacagtcctccagtcaccctgtctttgtctcgagggaaannccaccctctctgcacgggcagtcagaagtactaacngcgacttagcctaggtacccagaccacgaaaaccgtcggcctagccgtacccgaggtccctccgtacactacgttaatacgggtcgtccaaccgtaccgaacccgacggacctaccgtggtacaacgttcccgaagtacctacggtacgaggtcggtacgtaaggttcgggtaccgtagggaacgtagtaccgttacggtctacctccgaacttacgtcgacggactaacgaccgtaaggacgtacgtaacggaagttatttacggaacgtttaacgtttacgtttaaagttcggttaccgaaacgttaaccgtagaacccgtaaaacggtaccgttacgggtccccttaaggtttaaccggggaaccgttttacccggggaacgtaaaccggggtaaacccggtaagggtttaaaccgggaaaccgttaacaaaacccgggtttaaataaccgggttcggtaaaccggtcccgggtaaactaccggaacttttccgttaccggttacgttttaaccctcgggtttaacccccg

SEQ ID NO: 102528 - DNA, 651 bp, Homo sapiens
  misc_feature: GYAE6OF02GU2OX.51.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (492)..(492): a, c, t, g, unknown or other
  misc_feature (492)..(492): n is a, c, g, or t
tcagcgatcgtatacacgaccggtgctcgatttagatcacgtgcgtcgcgggggaagggaactgctcagttaggacccagagggaaccatggaagccccagctcagcttctcttcctcctgctactctggctccagatgccaccggacaaattgtgttgactacagtctccagtccacctgtctttgtctcgaggggaangccaccgtctcctgcgaggccagtcagagtataacngcgtacttagcctggaccagcaagaacctggaccaggcctacccgaggtccctcctcgactactagtgggcgctacgtacccgaccggacgggaccctacgtcggtactactcccgacggtaccgtaggtcaggtcgcgtaggtgggtcgtgggactacggtacgttcgccttaccgacacctataccgacgacaacggtcctaacggctaccgtagtaacgtttactttagacgtttaagtttattagttcgtanacgtacaaacggtaaccgaaaacttccggtcgtcccttacggttacgggtaccgttaccgggaacgtaacggaacgtaagggttacgaaccgtacgtaaacggtcttacggcggtacgtacgacctacgtcctacgttagttctaccgtccttacccgg

SEQ ID NO: 102529 - DNA, 824 bp, Homo sapiens
  misc_feature: GYAE6OF02GA562.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtctccagtccaccctgtctttgtctccgaggggaaagcgccaccctctcctgcagggccagtcagagttataacagcgtacttagccttaggtacccagaccaagaaacccgtgggacccaggcctcccgaggcccttccctcacttctattgggcgcactcccaccggacggccagtcgcctacctcccagtaccgtggttaccaggtcggaccgtaggggttccggggtccgtaacggggtactaaccgggttactttccccggccgtttacccttacccgaaccctacgtaccaaccggtaccgtaccggtacccgttaaggaaccggtccccggttaaaaggtaacggttttacgtttttacggaccttttaagtttttaacgttttacgtttacgttacgaacggtaaccgttaacggtaacccggtaaaacgttacccggttaccggttaccccgtttaccgggtttaccgggttacccgggtttaccgggaacccgtaaacggggtaacccgttaaagggtaaaccggttaaccgtaaaccggtaaaccggttaaccggtaggttaaccggtaccggtaccgtaacccggttacccttaacgggtttcccgttaacccgtttacgtttacccgttaccccgtttacccccgg

SEQ ID NO: 102530 - DNA, 721 bp, Homo sapiens
  misc_feature: GYAE6OF02H0X6W.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaggggaagacgccaccctctcctgcagggccagtcagagtataacagcgacttagctaggtacagcaacgaaacctggaccaggcctccgaggtcctcctcatctagtgtgcactccacgacgggccagtcggcactcccgagtccctaggttccaggtcggctaagggttcggggtcgtacgggggactacggtaccgtttccgaccgtttccctacctacccgtaaagtcccgtaacggtaccgtaaccggtccccgtaaacgggacgtaccccgttaaggtaaacgtttacgttttacggacgttttaaggttttaactttagtttacgtactacggtaccgaaggtaaccgtaaaaccgtacggttaccggtcccgtttaccggttaacgggtaccggtttaccgggaccggtaaacgggtaacccgtaaggggtacgtaaacgtaaccgtaaaccggtacgttacggtacggacgttacgaccgtacgtacgttacgttaccgttaccttacctacgttccccg

SEQ ID NO: 102531 - DNA, 778 bp, Homo sapiens
  misc_feature: GYAE6OF02IX6RA.51.83.H06.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtcctccagtcaccctgtctttgtctcaggggaangccacctctcngcaggccagtcagagttataacagcgacttagcctggtaccagactaagaaaccgttcggacccgaagggtccctacccgaggccccttccttacactcctaagttcgggtacgctacctacccgtaccggacgggtaccctacttcgggacctaccgtcccgaacgtccgtaacgggtttccaacgggttcggaccggtaaggggttcgggtaccgttaggggaccaacggttaccttcggtccttccgtaccaaccctcgttaccgacgtaccggtacgacccgttaaggtccgtaccggtaggaagtttagtttccggtaaccgtttaagtttttagttaacgttttacgtacgtacgtacgtaacgtacccggaaaactacggtaccggttacccgtttcgttaaccggggttaccggttacccgggtaaacccgggaagggttaaacccggtaacggggttaggaaaacctaccgtaaaaccggttaacggttacgggtacggtactaccgtacccgtacctacgtttacccggtatttacccgtttaccgactttaaccccgg

SEQ ID NO: 102532 - DNA, 742 bp, Homo sapiens
  misc_feature: GYAE6OF02FM4NQ.51.83.H06.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaattgtgttgacacagtctccagtcaccctgtcttgtctccgaggggaaangccaccctctacctgcagggccagtcagagtacttaacaggcgacttacgcctaggtaccagaccagaaacctggccaggcctcccgaggctcctcntctatggtagcactccaccagggccatcggcntacccagtcctagttcgaggttcggacgtaggtcggggtcgtacgggtaacaggttaaccttccgggtccttaccgtaccgtacccgtacgtttaccggaccgtaccgtaccggtaccttaacgggacccgtaccgtacggtaaaggtacttttcggacgtttaacggttttactttaaacggtttcgttaacgggtaacgtccgtaaacggtacccggtaaaaccgtaaccggttaggtaccccgtttaccgttacgggttacccgggttaccggggaacccgtaacgggttaacccgaacggggttaacgggtaaacgacgtaaacccggtaacggtttaggtaccggtaccgttacggaccccttaacgttacgttaccgtttaccgtactttaccgtacccgtttaccccgg

SEQ ID NO: 102533 - DNA, 687 bp, Homo sapiens
  misc_feature: GYAE6OF02JT7WV.51.83.H06.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
tcagcgatcgtatacacgaccggtgctcgatttagatcacgtgcgtcgcgggggaggaactgctcagttaggaccagagggaaccatggaagccccagctcagcttctcttcctcctgctactctggcctcccagatgccaccggacaaattgtgttgacacgagtctccagtcaccctgtctttgtctaccgaggggaacngcccaccctctccgtgcgaggccagtcaagagttaacttaacgagccgtacttacgccgttaggtaccaggactaacggaaccgtggcctacgggccttcccggaggtccctcctactactctaggttcggtacgcctaccgtacccacggacggtccagtcggcctacnccgacgcgtacgtcgacgtcggacgtggtacggtcgagggtacaggtccttcgctccgtacacatcgtacgaccgtccgacgtacgacgtccgtaagtacgttaagtttgactttagttacctttagttacgtcaggtaacgtacggaacgttaacgtaacccgttcgacgtttaccgtccggtacggttacccgacgggtaaaccggtaaccggtagtaacggtaccggtaacctaaccgggttaaaggtccggaccggtaacgcggtaaccttacgttaccgttacctcggtttaaccttccaacgtttcccg

SEQ ID NO: 102534 - DNA, 646 bp, Homo sapiens
  misc_feature: GYAE6OF02IP1AP.51.83.H06.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctcagtcacctgtctttgctcaggggaaanacgccaccctctcctgcacgggccagtcagagtattaacagcgtacttagcctggaccagcacgaaacctggaccaggcctccaggcctcctnatctatggncatccacgcggcctacgtgccactcccgagtccgtaggttcgaggtcgacgtaggtcggtcgngggactaggtcgttcnctccgtacaacccgtatccgaacgcgacgtaccgtacgacgtccgtaagtaatagttttcgacgttaagttttacgtttagttcgtacgtagtacgtaaggtaaccgaaacgtacgttcccggtaccgtttccgttacgggtacggtttacccgggaaccggtaaaccgggtaacgtaaagggttaacgaaccgtaaccgtaaacggcgttacggtcggtacctacggtacccacgttacgttcctacggtttcctacgtacccttcccgg

SEQ ID NO: 102535 - DNA, 733 bp, Homo sapiens
  misc_feature: GYAE6OF02HNYOH.51.83.H06.1.454.CMB.1.raw
  modified_base (335)..(335): a, c, t, g, unknown or other
  misc_feature (335)..(335): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccacccgttgttctttgtcctaccgaaggggaaagacgccaccctctcctagcgagggccagtacagagtaacttaacagcgacttacgccgtcggtacagtacaacgaaacctcggacctaggcctcccgaggccctccctcacgttcgttacgtggttacncctaccgtaccccgaaccggtacgggccctacgtcggaccctaccttaccgacgtacccgtaggttccgaggtcggtacgtggtcgggttcgtacgggtacgtacgtaccgttccggcttcccgtaactaccgtacgtccgaacgtcgaaccgtccggttaagaaccggtccttaagtaaacgtttcggtttacacggtttaagttttacgtttcgtacgtacgacgactagggaaacctaaacgtaccggtcgttaccttacggtacggtacggttaacgaccggtaaacggtaaccgtaagggttacgaacgtaacgtaaaccgggtagttccggtaacgtggtaacccgtctacccggagttcccgtttcgtaacctacccgtacctttacccgg

SEQ ID NO: 102536 - DNA, 817 bp, Homo sapiens
  misc_feature: GYAE6OF02IY6D4.51.83.H06.1.454.CMB.1.raw
  modified_base (336)..(336): a, c, t, g, unknown or other
  misc_feature (336)..(336): n is a, c, g, or t
tcagcgatcgtatacacgaccggtgctcgatttagatcacgtgcgtcgcgggggaggaactgctcagttaggacccagagagaaccatggaagccccagctcagcttctcttcctcctgctactctggctcccagatgccaccggacaaattgtgttgacacagtctccagtcaccctgtctttgtctccgagggaacgacgccaccctctcctgcacgggccagtcagtagtacttaacgacgtacgacgttacgccgtacggtaaccagaccgtaacgaaaaccgtcggccgaacgggtcctacccgacggtcctccctacactctagtggtcnctactccgaccgtacggccacgtcgacctacgtacccagaccgtaggtcacggtcggacgtagggtcggtacgtacgggactacggtacgttcgcgtcctaccacgtactcgacgtccgacgtaccgtacggaccgtaccgtaaggtaaacgttacgtttcggtacttaacggtttttaacttttacggttacgtttaaccgcgtaaaccgtaacgggttaaaccgtaaaacccggttaccgttacccgggttaccccgtttcggtttaacccggggtaacccgggtttaccgggtaaaacccggaaacggggttaaacccgggttaaaccgggggtttaaaggaaaaacccggttttaaacccggaaaacccggggttaaaccggttttaacgggtacccgggttaaccggttaccgttaaaccccgtaaacccggttccgttaccgttttaccggttaccccgttttaccctaacccgg

SEQ ID NO: 102537 - DNA, 889 bp, Homo sapiens
  misc_feature: GYAE6OF02IOFY7.51.83.H06.1.454.CMB.1.raw
  modified_base (235)..(235): a, c, t, g, unknown or other
  misc_feature (235)..(235): n is a, c, g, or t
tcagcgatcgtatacacgaccggtgctcgatttagatcacgtgcgtcgcgggggaggaactgctcagttaggacccagacggaaccatggaagccccagcgcagcttctcttcctcctgctactctggcctcccagataccactggagaagtagtgatgacgcagtctccagccacctgtctgtcgtctccgagggaaagcgcccaccctctcctgcgacgggcctacgtcaagngttgttacggcacgcgtacttacgccgttaggtaccagccaaaggaaacccgtcgggtccacgggcccttaccccgacgggtcccttacccttaccgaactttccgttaaacgtggtaacgttcggtaccctaaaccgttaccccgaaaccggtaaaccggggacccctaaacgttacgtaaaccgtttaaccccttaaccccggaaccggttaccccgtaaacggggttttaccgtaaacggggttaccggaccggtttaaacgggggttcggggggtttaaccggttaacggggggtaaccggtaaagggtttacccgtttacccgtaacccgtttcccgtaacctaaacccggtacgtaaccggtaaccgaccggtaaaccggttcccgttaccggtacgtaaccgggttcggttaaacggtaacgtttaacggtttttaacgtaaccgtttttaaattttaacgttaccgtaggttacctaaggttaacgttaaacggttaaattaaccgttaacgtacccgggttaacccttaaccggtttaacctttacgggttacggtaccgggtaacggtaccgtaaggtaccggtaaggtaacctaacgtaaaccggtaacgtaggttaccggtacggacgtaccgaccttaccg

SEQ ID NO: 102538 - DNA, 738 bp, Homo sapiens
  misc_feature: GYAE6OF02JS91L.51.83.H06.1.454.CMB.1.raw
  modified_base (186)..(186): a, c, t, g, unknown or other
  misc_feature (186)..(186): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (561)..(561): a, c, t, g, unknown or other
  misc_feature (561)..(561): n is a, c, g, or t
tcagcgatcgtatacacgaccggtgctcgatttagatcacgtgcgtcgcgggggaggaactgctcagttaggacccagagggaaccatggaacgccccagctcagcttctcttcctcctgctactctggcctcccagatcgccaccggataattgtgttgactccagtcctcaacgtctacccgtnttcttgtcctaccgaagggggaaatccgaccctaccctctcccgtgccgacggactacgtcaaggttacgtaattaacacggtcgtaacttacgcttacggacccaggcctaagaacctcggaccgagtcctccgaggtccctccgtactacnccttaagttcgggccacgccttaccacgggcggtaccngtcggtccacgtcccaggccccttaaggtcctggcgtaaccgggtnttacgggtcgtaacgggtctaacgtccggttcgcttacccggaatccccggaaattccgacggtcgtacggtacctaccgggtataacccgagtaaccggttactttacgggatttacgtttacgttatttccgaagngaccgtagaaacgtaccgtaacgttcgacgttacccgtggtaaccgtccgggtaacaaccgggtacttaacggggaccttaaattaccccgggagtacccggttcgggttaaacggccttaaccgtacgtaccccgttgaacccggttttgtaaccccttcgggaaccctttcccgg

SEQ ID NO: 102539 - DNA, 657 bp, Homo sapiens
  misc_feature: GYAE6OF02F76KH.51.83.H06.1.454.CMB.1.raw
  modified_base (302)..(302): a, c, t, g, unknown or other
  misc_feature (302)..(302): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtcctccgaggggaaagacgcccaccctctcctgcgagggccagtcagagtataacagcgacttagcctggtaccagcagaacctggccaggcctcccaggcctcctcatctatggtncatcccaccgacgggcccacgtggccactccccagtcccgaggttcaggtcggcaggtgggtctagggacaggtaccttcgcgtcctaccacctactcacgacgacgtaccctaggacgtccgtaggaagttagtttacgcgttaagttttactttagtttcgtacgtagtacgaacgtacggaaacgtaccgtacggtaccgttccgttacgggtaccggttacgggaacccggtaaacggggtaacccgaagggttaacggtaacgtaaccgtaaacggtaacgttacggtacgggtaactcggtactaacccgttacgttacgttacgttcccgttactaccgttacccccg

SEQ ID NO: 102540 - DNA, 745 bp, Homo sapiens
  misc_feature: GYAE6OF02FUFWJ.51.83.H06.1.454.CMB.1.raw
  modified_base (197)..(197): a, c, t, g, unknown or other
  misc_feature (197)..(197): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctcaggggaanacgccacctctcctgcacgggccagtcagtatataacagcgtacttagcctaggtaccagacaagaaaccctggacccagggtcctaccccgacggtccttacccctacgtacttacccttaggttacggggactaccgaaccttaccccgaacccggtaaccgggggtacccaacgttccgggaccttaacctacccccggaacggtaccccgttaacgggttactaacgggtcggtaccgtaggggttttcggggtaccgtacgggggaactaccggttacgtttcccggacctttaccccgacctaacccgagtaccacggtccgaacggtcccgtaaagccgtaccgttaagaacgtttatttacgtacgttaagttttacgttagttctacgtaggaccgtagaaccgtaactacggtccgtacccgttacgtcgggtccgttacgggaaccgaacgggtaacaagggtaccgaacaacggtaacgtaagttggacgtctacggaccaccgtacttcggttacttacgtccctacgttccccg

SEQ ID NO: 102541 - DNA, 744 bp, Homo sapiens
  misc_feature: GYAE6OF02F5QOL.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagatcgccaaccggacaaattgtgttgacacagtctcagtccacctgtcttgctcgaaggggaancgccacctctcctgacagggccagtcagtagtataacacgctacttacgccttaggtacccagtccaaggtaaacctggacctaacgggtcccttacccgaggtccctcccgtctaacttccgtaagtttcggggttcaccaccttacccgaaccggtagggtcccctacgtacgggccaacgtccccgaaggtccccgtaggtcctagggtcggactacggggtggtccgtacgggaactacgtccttcggcctcctacggaaccctacgtacgacgtccacgacccgttaagaaccggtccgtaaggtaaaccgttagtttttaccggaaccgttttaagttttaacgtttaacgttaccgtaactaccggacgtaaacggtaccgtaaaaccgtacctccggtaccgttccgttacgggtaccgttaccgggacgtaaaccgggtacctaacggggtactaaacgtccgaaacgggtactacgggtaccgtctacggccctaacgtcggtaccttaacggtcctttaggtacctttccccgg

SEQ ID NO: 102542 - DNA, 664 bp, Homo sapiens
  misc_feature: GYAE6OF02HUZQN.51.83.H06.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (321)..(321): a, c, t, g, unknown or other
  misc_feature (321)..(321): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctccagatgcccaccggacaaattgtgttgacacagtctccagtccaccctgttctttgtctccgagggaaanacgccacctntcctgcagggccagtcagatataacagcgtacttagcctaggtaccagcaacgaactcgcaggcctccagctcctacatctagtggtcgcactccaccgacggccacgngcactccacgcctaggttcaggtcggctaggtcgggtcgtgggaactacggtccttcgccttccgtaccaccctaatccgaacgcgacgtccgtacgacggtacctaggtaagttacgtttagtacgttaagttttaacgtttacgtttacggttacgtacgtacgaacgtaaccgaaacgtaccgtaccggttaccctaccgttacgggtaccgttaccggaccgtaaacgggaccgtaagggtaacgtaactaacggtaaaacccgtaggtacggttacggtacgtccggtaaccacgtcccgttacgttaccgtttaccttaccgttaaccgttcccccg

SEQ ID NO: 102543 - DNA, 771 bp, Homo sapiens
  misc_feature: GYAE6OF02H2CYK.51.83.H06.1.454.CMB.1.raw
  modified_base (201)..(201): a, c, t, g, unknown or other
  misc_feature (201)..(201): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgcccaccggaacaaattgtgttgacacagtctccagtccacctgtctttgctcgaggggaancgcccacctctccgtgacgacgggccagtcaagagttaattaacaggccgtatttacgcgtacgggtaccagccgaagaaaccgtggccgaggtccctacccgaggtccttccctacatttccgtagtcggtacgacctaacgtccaaccgacgggacctacggtcggacctacctcccggaagtccgtagggttacgaggtcgggacgtaggggttcgggtacgtcgggaaacctacggttaacttccgaccttaccctaaccgaaccgtacgtacgacgtacgtaccgaccgttaacggacgtacgttaagtaacgtttacgtttacgtaaccgtttaagttttacgtttaacgtttacgtaccgtacgttacgaacggtaaccgtaaaccgtaaccggtaccggtttcccgttacccggtttagggacccggtttaccggaacccgggtaaacgggtaaacgtaaccggggtaagtaaacccgttaacgaaccggtaaacgtgggttaccgaacgttacgaccgtaacctaccgttcgttaccgttcgttaccctacggttaccccc

SEQ ID NO: 102544 - DNA, 797 bp, Homo sapiens
  misc_feature: GYAE6OF02GHJUP.51.83.H06.1.454.CMB.1.raw
  modified_base (199)..(199): a, c, t, g, unknown or other
  misc_feature (199)..(199): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtctcagtcaccctgtctttgtctccgaggggaancgccaccctctcctgcacgggccagtcgagacgttattaacgagtcgtacttacgccgtaggtaccaggccgaacgaaaccgtcggacccgaggcccttacccggaggtcccttccctactacgtcgttagtggtcgctacctcccgaaccggacgggccctaacgtcgcctactaccccgcgacccggtaggttccgacgggtcggtacgtacgggggttcggtccggtacgggggaactacggtaccgtttccggactttacccgtacgtaccctaacgtcggaacgtccgtaaccggtaccgtacgggtacccgtccgttaagggttaacgtttacgtttacggtacccgtttaaggtttttttatacggtttcggttaaccggaacggtacctaacgggaaccgaaaacccgttcggttaccgggtacccgtttaccggttaccgggtaaccggggttcccgaaaccggtaaaccggggtaaccggtaagggtaacggtaactaaccggtaaccggtaagttaccgggacggtaccgtcgaacccttacgtccgtttacccggtacgttttaccggtacttcccggttaccccg

SEQ ID NO: 102545 - DNA, 729 bp, Homo sapiens
  misc_feature: GYAE6OF02HXZ3Q.51.83.H06.1.454.CMB.1.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctccagatgccaccggacaaattgtgttgacacagtctccagtccacccttgttcttttgtctccgaagggggaaagcgcccaccctctcctgcgacgggccagtcagagtattaaacngcgtattacgcctggtaccagacaacgaaacctggaccaggccctcccgaggcctcctacacttctagtggtncctactacccgaccgcggccacgtcgctaccacccgagaccgtaggttcgaggtcgcgtagggttcgggtcgtacggggactacggtaccgttccgtccttacctaccgacctacgtaccaacggcccgtacggtaacccgtaacggtaccgtaccgttaaggtaaacgttttacgtttacggacttttaaggttttttaaacttggtttacgtaccgaacgttaccgacgtaaacccgtaaatcccggtacgtcccgttttacgttaacgggtcccgtacgggaaacccggtaaacgggaaccgtaagggtaacgtaaacgtaaccgaaaaccggttggttcggtaacggcttaaccgcctaaacgttccgttccgttaacgtttcccttactaccgtttacccccgg

SEQ ID NO: 102546 - DNA, 648 bp, Homo sapiens
  misc_feature: GYAE6OF02FYAWW.51.83.H06.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (350)..(350): a, c, t, g, unknown or other
  misc_feature (350)..(350): n is a, c, g, or t
  modified_base (385)..(385): a, c, t, g, unknown or other
  misc_feature (385)..(385): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccgaaggggaacncgcccaccctcctccgtgccgaggccagtcgagtagtaataacagcacttagcctggaccngcaagaacctgccaggcctccgnggctccnattcatggngcactccacacgggaccncgtggcactccagccgtagtcacgtggacgnggttgggtcgaggaccaagtcctcgtaccgttccnccctaaccagtccgaacgtccgacgtaccgtttacgaacgtccttaaggaaactttacgtttacgaccgttaagtttttaatcgttacgtactacgggactaacggaccgtaaaccgtaccttacgggtccttaacccggtagggtaccgtaccgacggttaaacggcgtaacgttacgaactaaactaaccggtataccggtaggcccgttacgaaccgtaccggtacttcccggttaacttcgttacttcccgttaccccg

SEQ ID NO: 102547 - DNA, 790 bp, Homo sapiens
  misc_feature: GYAE6OF02JTTXP.51.83.H06.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggcctcccagatcgccaccggtactaaattgtgttgacacacgtctcagtccacccttgttctttacgtctaccgaagggaaacgcgccctacccttctaccnggccgacgggcctaaggtcaggtacgttaataaccgnggtaccgtacttacgcccttacgggtaaccaggaccgtaacggaaacccgtggacccgaggtccctacccgcggaccttccgactatccgtagttcgggctacaaccgttcccgaccgacggtcccacggtcggacaccctccggacgaccgtacggtcaaccggtggaccgtaggtcgggtaccagggtacctacggtaccttccggtactcccgtaccgtaaaccctgtcggtaaccgtacgaccggtaacgtaggtaacccgtctaaaggttaacggtttatttacggtactttaaggttttaaccttggtttaccacgtaacgtcaaccgggtaccgtaaactccggttccgtaacccgttccggttacgggttaccgttaccgggtaaaccgggacgggtaaccgtaacgggtaacgttaaacgccggtaaacggtaaccgggttcggaacggttacgttaaccggaccctacggttacgttccgtttaccggtcggtttaacccttccggtaccccg

SEQ ID NO: 102548 - DNA, 710 bp, Homo sapiens
  misc_feature: GYAE6OF02JONOZ.51.83.H06.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgtgacacagtctccagtcaccctgtcttgtcctcgaaggggaaangcccaccctctcgcgcgacggacncgtacgaagtacgttaatacgacgacgtacgtaccgtaccggactagaccgtaacaaccggtacgccncggtccctaccgaccgcctctactactctagtcggcactacctaccgacgacggcctacgtacgctaccgaacctcgaccgtaagtcgaggcggaccggtggttaccggcggtaggaaccgtgttccgcgttaccgcctacgtccggaactcgacgtacgaacgtaccgtaacgcggtacctaaggtacgttacgttagtacgttaatttaccgttagttcggtacaccgttaggaaccgtaacgtaaccggtacgtccggcttttaccgggaccgttaaccgggttcccgaaccgggtaacggaaaccggtaaggtaacctaacggtacccgtaaagtaccgggttacgtaccggacggtccctaacgccgtttaacttccggtaacgttccgttacccgttacgtacccgttaccgg

SEQ ID NO: 102549 - DNA, 884 bp, Homo sapiens
  misc_feature: GYAE6OF02FW1OE.51.83.H06.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
tcagcgatcgtatacacgaccggtgctcgatttagatcacgtgcgtcgcgggggagaactgctcagttaggacccagagggaaccatggaagccccagctcagcttctcttcctcctgctactctggctcccagatgccaaccggacaaattgtgttgacacagtctccagtcaccctgttctttgctccgaaggggaaangcccacctctcctagccagggtccagtcaggagttattaaacgngcgtacttacgccgttggtaccagccaacgaaccgtggaccaggcctacccgaggtcctcctcagttctagtcggtagccacgtcccgaccgacgggaccctacgcggtacctaccgtccccgtaaggtaccctacgggttacgtacgggtcggtacgtaggggttcggggttacggtaacggggacccttaacgggtaaccgtttcccggtaccgttccctaaccgtacccgtacgtaccgtaaaccgggtccgtaaacggtaccccggttaaggaaaccccgttcccggttaaaggttaaaaccggttttagtttttacccgggtaaccttttaaggggttttttaactttaacggtttcggttaaacccgtacgggttaaacccgtaacggttaaaccgttaaaacccggttaacccggtaaccggggtttacccgtttaccccgggttttaccgggtaacccgggttttccccggggaaaccggtaaaaccggggttaaccgtaaaacgggggttaaccggaaaccgttaaacggtaaccggttaaccgggttacggttaccgggtaccgtaccgtaacccgttaaccgtaccgtttacgttccggttacctttaccggtaccctttacccccgg

SEQ ID NO: 102550 - DNA, 773 bp, Homo sapiens
  misc_feature: GYAE6OF02IVJ9M.51.83.H06.1.454.CMB.1.raw
  modified_base (166)..(166): a, c, t, g, unknown or other
  misc_feature (166)..(166): n is a, c, g, or t
  modified_base (303)..(303): a, c, t, g, unknown or other
  misc_feature (303)..(303): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggctcccagatcgccaccggactaaattgtgttgacacngtctccatcaccctgtctttgtctcgagggaagacgcctaccctctcctgcgacggtaccagtcagaattataacgagccgacttacgaccgtacggtaccacgaccaaacggaaaccctggaccccgaggtacccnccccggtacggccctacttaccaatccgtaagttggtacgaccgactacccgaaccgtacgggcctaacgtcggactaccacccgagtacccgacggttcgaaggttccgagtagggttaccgggtgacgggtaaccacggttactaccgtcttaccctaccgtaacacctaacaccggactaaccgtaccgtacggtaccgaccgttaaccgggttaaaattcgtttagaaccgttttaagttttacgtttacgttacgttaccgaggtaaccttaacgtaaaccgttaacaaaccggttacccgttcccgttaaccggttacgggttacccgttaaccggaaccggtaaacggggtaaactaacgggaacgtaacgtaaacgtaaaccggtacggttacggtacggtacgttaaccgtctaacccggttacgtttccgtacggttttacctccgttaaccctccccgg

SEQ ID NO: 102551 - DNA, 725 bp, Homo sapiens
  misc_feature: GYAE6OF02GXHBZ.51.83.H06.1.454.CMB.1.raw
  modified_base (255)..(255): a, c, t, g, unknown or other
  misc_feature (255)..(255): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgcccaccggacaaattgtgttagacacagtctccagcccaccctgtctttgtctccgaaggggaagacgcccaccctctccgtgccgagggccagtgagtagtattgactattccttnttcgggccctaggtaacccaacgacgaaacctggaccaggcctccccgacctcctctatttatgatgacactaccgtaaaagggtcgttacggctactcccagccctaggtcgaggtggacgtaggtggtcgagggtacagtatcgactctacaccactaccaccgaacgtactacgacgaccgtaagtaaagttagttttacgaactttagtttaacttaccgttaggtacctacgtacgtaacggtaaccgtaaaccgtaacgttcgtaccgtttaccgttaccggtttacggggaccgggtaacggggtaaccggtaacggggttagggtaacggtaaacgtaaaccggtaaaccggttacggtacggttacggtaccggtaccggaaccgttaacccgtacgtttaccgtttaccgttacccttttagtaccccgtttaccccgttcccgttacctacgtttaccg

SEQ ID NO: 102552 - DNA, 808 bp, Homo sapiens
  misc_feature: GYAE6OF02HAPHO.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtccaccctgttctttgtctccgaggggaagacgcccaccctctcctgcgagggccagtcagagtaataacagcgtacttagcctaggtaccagcaacgaaaccgtcggaccaggcctcccgaggtccctcctcatcctagtcggtcgactactcccgaccggtacgggccctacgtcggacctaccgtccccgaggtacccgtagggttcgagggttcggacgtaggggttcgggtcgtaggggacacggttaccgttccgtcgttacctaccgaacctactacgacggacctaccggtacccgtaaggccgtaccgttaaggtaaacgttttcgttttacgggaccttttaaggttttaactttaggttaccgttacgaacgtaccgtaaacggtaacccgtaaaacgttacccgggtaccgtttacccccggttacgggtttaaccggggttaaccccggttaccggggaaacccgggtaaaccggggtaaacccggttaaaggggttaaccggttaaaaccgtaacccgggaaaaccggtttaacggtcggggtaaccgtaccggtaccggtaacccctaacggttcgttacccgtttaccggtttcccgtttaaccgcccgttttaccccccg

SEQ ID NO: 102553 - DNA, 786 bp, Homo sapiens
  misc_feature: GYAE6OF02IWL66.51.83.H06.1.454.CMB.1.raw
  modified_base (206)..(206): a, c, t, g, unknown or other
  misc_feature (206)..(206): n is a, c, g, or t
tcagcgatcgtatacacgaccggtgctcgatttagatcacgtgcgtcgcggggggaggaactgctcagttaggacccagagggaaccatggaagccccagctcagcttctcttcctcctgctactctggcctcccagatgcccaccggacaattgtgttgacacagtctccagtccaccctgttctttgtcctaccgaggggaaanacgcccaccctctcctgcgacgggccagtcagtaagtaattaaccagccgtacttacgccgtacggtaccagccaacggaacctggaccgacggcctcccgaggtccctccgtctacttcgtagtcgggtcgtccacgtcccgaccgtacgggacctacggtcggaccaccctcccggaacgcccggtaacggttgaacgtcggacgtaggggttcggggtacgtacgggtactacggttaccgttccgtaccttacccgtacccacccgtactaccgaccgaccgtaaccgtaccgtacgtaaccgtcggtaaggttacgttacgtttcggtaccgtttaagttttacttacgtttaggtaccgtacggtaccgtaacggtaaccgtaaaaccgtccgttaccgggtaccctttaccgggttaccgggtacccggttaccgggaaaccgggtaaccgggtaaaccggtaagggttaaaccggtaacgtaaccgaaaacgggttacgtacgggtacggttacgtaccgtacctaacccggtattccggtaacctttccgtacccgttaccgttacccccg

SEQ ID NO: 102554 - DNA, 890 bp, Homo sapiens
  misc_feature: GYAE6OF02FJVHI.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaccggacaaattgtgttgacacagtctccagtccaccctgttctttgtcctaccgaggggaaagacgcccaccctcttcctgcgacgggccagtccagtagttacttaacgagaccgtacttacgccgtggtaccgacgacgaacgaaacccgttcggaccgaacgggtcctacccccgacgggtcccgttccctaccgtacttaccttaacgtcgggttcgaccgtaccttaccccgaaccgtacggggaccctaccggtcggtactaaccctcccgacgtaccccggtaggttcgaggtcggtacggtacggttcggggttcgtaggggtactacggtaccgttaccggtccttacctcctaacccgacgtaccgtacgacgtaccggtacccgttaacgggaacccggtacccgtaacgggttaaacgtttaccggttttacggtaaccgtttaacgtttttaagtttaaccggtttacgttaccgttaacggtacgtaccgggttaaacccgtaaaaccgttacccggtaccgggtttaccccgtttaccgggtttaacccgggtttaacccgggttaacccgggtaaccccgggtaaacggggtaacccggtaaacgggggttaaccggtaaaccggtaaacccggaaaccggttaacggttacggttaccgggtacggtttaccgaacccgttaacccgtacgttaccgttacggttaccgtttaccgtacctttacccccgg

SEQ ID NO: 102555 - DNA, 719 bp, Homo sapiens
  misc_feature: GYAE6OF02FU74P.51.83.H06.1.454.CMB.1.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccactggagaagtagtgatgacgcagtctccagcccaccctgtcctgtcgtctccgaaggggaancgccctacccttctacctggccgaacgggccaagtcgaagagttgttacgcagcgtacttagcctggacngacaacgaacctggacaggctacccaggtcctacctnattacctaagtgaactgactacctccgaacgtacgggtcccaacgttgtaacctacgtcccccggaggttacccgtaggtttcccgaaggggttcggaccgtaggttacggggtcggttaacgggacctagggttaaacccttcctaaccgttaccctacggtacccaacgtttacgaaccgtcgtaaaccggtccttacggtaaccgttacggtaccgttaaggttaaccggtttacgttttaagaacttttaaactttactttacggtacggttacaacggtaacgttaaacttaacgttaacgttaccggtaccgttacccgttaccgttacgttcggtttacgggaccgtaacgggactagaccgtagaactacacggtaactacggtggccgtactaggaccc

SEQ ID NO: 102556 - DNA, 738 bp, Homo sapiens
  misc_feature: GYAE6OF02GH5WB.51.83.H06.1.454.CMB.1.raw
  modified_base (488)..(488): a, c, t, g, unknown or other
  misc_feature (488)..(488): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatcgccaccggacaattgtgttgacacagtctccagtccacctgtcttgtctaccgagggaagcgccacctctcctgcgacggccagtcagatataacgcgcgacttgccgtgaccagacaacgaacctgaccgagcctaccgacgtcctacctagacttctagtgtcgctaccgtacccgacggacggaccacgtcggacctaccgtacccgacggtaccgtacggttcgaggtcggtacgtacgggttcgggtacgtacgggaacgtacgtaccgtcgtaccttaccgtaccacgtacgccgtaacgacgtaccgtacgtagaccgtacgttagttaacgttacgtttanactttaggttttattaacgttcgtaccgtaagtacgtaaacggtaacccgtaaaccgttacgttaccgggttaccccttacgggttacccgggttaccgggtaacccggtaaaccggtaaacggggtaaccgttaaacggggtaactaaccgttaccggaaaacgggttacggttcggtaacggtacctaaccggtcccgtaaccgtttcggttacgttccctttaccggttacccgtcgtttaccccgg

SEQ ID NO: 102557 - DNA, 750 bp, Homo sapiens
  misc_feature: GYAE6OF02HSS3E.51.83.H06.1.454.CMB.1.raw
  modified_base (219)..(219): a, c, t, g, unknown or other
  misc_feature (219)..(219): n is a, c, g, or t
  modified_base (373)..(373): a, c, t, g, unknown or other
  misc_feature (373)..(373): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttagacacagtctccagtccacctgttctttgtctcgaggggaagacgccctacccgtctccngcgacgggccagtcagtagtaataacgacgacgtacgttacgcctaggtaccagaccaacggaaaccgtgaccgaggcctacccgaggccctccgtacattcttacgtggttcgacctactcccgaaccgacggaccacgtcggacacgtcccngtaccaggttcaggtagcgtaggtcgggtacgtaggacgtagtaccgtcgctccgtacctacgactcgacgacgtaccgaccgtaacggaccgtaccgtaaggtaaagttacgtttgtacgtttaagttttaatttacgtttcgtacctaaggaaccgttaacgaaaccgtaaaacgttaccggttaccgtacccgtttaccggttaacgggttaaccgttacccggggtaaacgtaaaccgggtaaaccgtaaacgggttaacggaaaaccgtttaaccggaaaacggttaaccgttacgggtaccgtaccgttacggtaacccgtacgtaacgtttacccgttacggttaaccctttacggacccttttaccccg

SEQ ID NO: 102558 - DNA, 833 bp, Homo sapiens
  misc_feature: GYAE6OF02FRXW7.51.83.H06.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggcctcccagatgccaccggacaaattgtgttgacacagtctccagtcaccctgtctttgtctccgaggggaaancgcccacccttctcctgcgagggccagtcagagtataacagcgacttagcctggtaccagcaagaaccttgaccaggcctcccaggctccgtcatctagttgggtncactaccccgaccgacggggccctacgtgggacctactcccccgagcccgttaggttccaggtcggcgagggttcgggtaccgtaggggactacgtaccgttccggtaccttccgtacctaacccgtagtccccgtaaggtacccgtacgtaccccgtttaaggaacccgtaccggtaacggttaaacggtttacgttttttaccgggaaccgttttaaggttttttaacgttttaacgttttgggttaacccgttaacgggtaacccgttaaacgggtaaacccggtaaaaacccgttaaaccggttccgggttaaccccgtttacccggttttacggggttaaccccggggttttaacccgggaacccgggtaaacccggggttaaacccgggtaaggttaaccggggttaaaactaacccgggttaaaaccgtccgggttaaggtccccggggttaacgtaccgttaaccggaacccttcggttacccgtttccgtttaccgttaccttaccgttacccccgg

SEQ ID NO: 102559 - DNA, 566 bp, Homo sapiens
  misc_feature: GYAE6OF02FFCPI.51.83.H06.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaatttgtgttgacacagtctccagtcaccctgtctttgctccaggggaaangccaccctntcctgcagggcccagtcagagtataacngcgacttagccctggtaccagcagaaacctggccaggctcccaggctcctcatctatggtgcagtccaaccagggccactggccattcccagccctaggttcagtggctagtgggtctgggacagacttcgcttctcaccatccagtcacgactacgacgtccctagaagtacttttgctagttttattagttgttcagcaggacaaaacgactggtcccttaccgttacgggtacgtttcgggaccctaaagggaccaacgggtaggtaactacgtaaacgtaaccttagcggtacgtcgacgacctatcctgtcctttacacttcccg

SEQ ID NO: 102560 - DNA, 714 bp, Homo sapiens
  misc_feature: GYAE6OF02JESM6.51.83.H06.1.454.CMB.1.raw
  modified_base (147)..(147): a, c, t, g, unknown or other
  misc_feature (147)..(147): n is a, c, g, or t
  modified_base (162)..(162): a, c, t, g, unknown or other
  misc_feature (162)..(162): n is a, c, g, or t
  modified_base (210)..(210): a, c, t, g, unknown or other
  misc_feature (210)..(210): n is a, c, g, or t
  modified_base (252)..(252): a, c, t, g, unknown or other
  misc_feature (252)..(252): n is a, c, g, or t
  modified_base (426)..(426): a, c, t, g, unknown or other
  misc_feature (426)..(426): n is a, c, g, or t
  modified_base (706)..(706): a, c, t, g, unknown or other
  misc_feature (706)..(706): n is a, c, g, or t
tcagcgatcgtatacacgaccggtgctcgatttagatcacgtgcgtcgcgggggaggaactgctcagttaggacccagagggaaccatggaacgcccagctcagcttctcttcctcctgctactctgctcccagactgccaccgganaaattgtgaacgtanactctctacacgtcctccttgttcttacgtccgaacggaagggtaacncctaccctcctaccttgggccaggtcggacctgtctaaacgngttaaccaatacggccttagttaccgcgttaccgacgaacgtcgaaccgaaccggtctaccggacgtcccttaccgagccttccaccgtatccgtagttcggacccacgtaccggtaccgtaccggtacggaccttccggactacctccggtacccgtatccgggtaccgtacncgggttaacggtcgacggggtacttcggaccggtaacgcctttacgacgacccttccaacggccctaagccccgagtaccgacgaccgtaagtacgttactagtaacgtttacgtttaagtcttatacggttcgtacgtcaaccgtagtacgaccgtaacgtaccttcggtaccgtttcgaccggtaacgtaccggtaacggacgtaaacgacgtaacgtagacgtacggtcgttaccgagtaccctagaccttacgtacgttaccttacgtccgttacncttacccg

SEQ ID NO: 102561 - DNA, 757 bp, Homo sapiens
  misc_feature: GYAE6OF02GVC11.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgaccaccggacaaattgtgttgacactagtcctcctagtccaccccttgttccttttcgtcctaccgtaagggggaaaagacggccctaaccccgtccttccctgaccgacgggccaggtccgaagagttaacttaacgagtaccgtaacgttacgtaccgttaggtaaccagacgaacgtaaacctgggaccgacggtccctacccgacgaccctcctacgtatcctaggtggttcgacacgtacccaccggtaacgggccctaggtcggaccaccgttaccccacggtaccgtacggttactacgggtcggtacctagggttcgggtacgtacggggaacgtacgtaccgttggtaccttaccctccaaacctcgtaaccacgtaccacgtaccgttaacgacgtaccgtagtaacgttagtttacgtactttaagtttacgtttagttacgttacagtacgaacggactaaacgtacgtaccgtccgtttaccggttacggtaccgggttaccggtaacccgggtaaaggaacccgtaacggtaacgaacgtacgaaaccggtaggacggacgtccgacgacgtccgacgttcgtacgtttacgtcgtacctcccg

SEQ ID NO: 102562 - DNA, 726 bp, Homo sapiens
  misc_feature: GYAE6OF02IO1HP.51.83.H06.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (659)..(659): a, c, t, g, unknown or other
  misc_feature (659)..(659): n is a, c, g, or t
tcagcgatcgtatacacgaccggtgctcgatttagatcacgtgcgtcgcgggggaggaactgctcagttaggacccagagggaaccatggaacgccccagctcagcttctcttcctcctgctactctggcctccagatcgccacggacaaattgtgttgacacagtctccagtcacctgtctttgtctcgagggaancgccaccctcnctagcaggccagtcagatattaacngtacgtacttagcctggtaccagacaagaaacctggacctaggcctacccaggtcctacgtctatacttaagtgggacgtctacgtacccaacggacgggtccaacggtcgacctacctccacggtacctacggttagaggtcggaccgtagggtcggggtacgtagggacgtacgtacttcgacctacctacgaaccttactcgtaacgcacgtaaccctaggaacgtcttaaagaacgttttgtttacggtaacgtttagtttttaatttacgttaacgtcgtaaacgggttacctaaacgggtaaccgtaaaacgttaccgttaacgggttaccccgtacggtttaccggggtaacccggttaccggaaccgggttaaaaccggaacgttaaacgggttaacgaaacgtaaccggtaaacggnggtttacccgacggtaccgacgtaaccggtaccagtttacccgacggttacttccgacttaccccgg

SEQ ID NO: 102563 - DNA, 785 bp, Homo sapiens
  misc_feature: GYAE6OF02G126E.51.83.H06.1.454.CMB.1.raw
  modified_base (211)..(211): a, c, t, g, unknown or other
  misc_feature (211)..(211): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
  modified_base (760)..(760): a, c, t, g, unknown or other
  misc_feature (760)..(760): n is a, c, g, or t
tcagcgatcgtatacacgaccggtgctcgatttagatcacgtgcgtcgcgggggaggaactgctcagttaggacccagagggaaccagtggaacgcccagctcagcttctcttcgtcctgctactctggcctccagatcgaccacggacaattgtgttacgacacagtccactacgtcctacctgttcttcgtccgtaccgaaggggaacncgtacccgaccttcgtacgttacgggaaccggcctaacggttaccgaagtaacggttaacttaaccgacggtaccgtaacgttaccgtcgtacggtaacacggaccgtaacgtaaacgtcggaccggtagcccgttaccgacgccttactacggtaacttcctaagggtttccggacgtaccctaacggttaccccgaaccggacggtacccgtaacggttaccggcccgtaaaaccttcccgggacccgttacccggttaggttaaccgacgggttcggaacccggttagggtccggggtttaacgccgggtaaacgcgtttaccggaccggttcctaaccggttaccgaaccgttacgaccgttaggaccggtaccgtaaacccgggtgtaccgcgttaacgtaagttccttagtcgttagttaattcgtntaccganacgacgaacacggtactcggtaccttgacgttacgccgtaacgacgtaacggttacgaacgttaacacgtaaacgcggtaacggttcgacgactaccgagacgttcgtnttactaacgtccgttaacctcccgg

SEQ ID NO: 102564 - DNA, 800 bp, Homo sapiens
  misc_feature: GYAE6OF02IQVXV.51.83.H06.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
tcagcgatcgtatacacgaccggtgctcgatttagatcacgtgcgtcgcgggggagaactgctcagttaggacccagagggaaccatggaagccccagctcagcttctcttcctcctgctactctggcctcccagatgaccaccggacaaattgtgttgacacagtctccagtccaccctntctttgtctccaggggaaancgcctaccctctctgcacgggccagtcagagtataacngctacttagcctggtaccagcagaaacctggaccaggctcccaggcctcgtcatctatggcnctactccgacctagggccacgtggaccacgtacccaggaccctagggttaccaggttcgacctagggtcggggtacctaggggaactacggtaaggtttccaacgtttccgtaaccgtaacctagttaccgaacgaccgtaaccgacccgtacggtaccgtaacggttaacgttacgtaaacggtaacgtttttaggtaaccgttaaacgttttaacgtttaaccgttacgttaaccgtaacggttacctaaaggttaaacttaaaacgtttaaacccgttaccgggttaacccgtttaccccgttaacgtttaacccggttttttaaccgggaacccggttaaaaccgggggtaacccgtaaaccgggtaccggttaacgggtaacggtaaaccgttaacccgtaaaaccggttaaaccggttacggttaaccgggttacccgtttaacggaaccccgttaaccgttaaccggttttacccgttacgttttaaccccg

SEQ ID NO: 102565 - DNA, 690 bp, Homo sapiens
  misc_feature: GYAE6OF02JZWKJ.51.83.H06.1.454.CMB.1.raw
  modified_base (641)..(641): a, c, t, g, unknown or other
  misc_feature (641)..(641): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacactagtctccagtccaccctgtctttgtaaaaactccagggaagagccacctctcctgcagggccagtcagagtataacagcgacttagacctggtaccagcaagaaacctggtccacggctcccgaggcctcctactagtctacgtgtcgcactccacgacgggtccacgtcggcacgtccgcgacctacggttcagttcggctacgggtgggtccgtagggacgtacgtacttcggacccttacctaccgacctactacgtaaccgccgacgtcccgttaagaccggtaccgtacgtaacgtaacgttttcgacgttaacggttttattacgtttacggttacacggtactaacgtacccgtaaactaccgttacggtcccgttaccgttacgggtaacccggttaccggtaccgtaaacggggtaaccgagggttaaccgtaacgtactaaccggtaacgtaggtacgtaccggttanacccggtacttacgtaccgttacggttacctccgttaaccgtttccccg

SEQ ID NO: 102566 - DNA, 823 bp, Homo sapiens
  misc_feature: GYAE6OF02G0WCK.51.83.H06.1.454.CMB.1.raw
tcagcgatcgtatacacgaccggtgctcgatttagatcacgtgcgtcgcgggggaggaactgctcagttaggacccagagggaaccatggaagccccagctcagcttctcttcctcctgctactctggctccagatgaccaccggacaaattgtgttagactacagtctccagtccaccctgttctttgtctaccgaaggggaaagacgtcccaccctctccgtcggaccgtacgggccctaggtacaaggtacgttaacttaaacgacggtaccgtacttacggaccgttacgggtaaccaacgaccaaacggtaaaacccgtcggaccgacggtacctacccgaccggtccctccctacctacttaccgttagttcgggtacgacctaccgtacccgacccggaacgggacctacggtcggacctaccgtacccggacggtaccggtacggttcgaacggtcggacggtacgggtttcgggacggtacgggtaacgtaccggtaacgtttccgccgttacctaccgtacctacgtacccacggacccgacgtaccggttaacgacggtacggttaagtaacgtttagtttacgttaggtttaattttcgtttagttagtaccgtagaccgtaacggaaaccgtaaccgtaacgttcccggttacccttcgggttaacggttccggtaaaccgggtaaccggaaacgggtaaccggtaaaggtaaccggttaaacgaacgtaaacgggtaccgtacggggttaacgaaccgttcggaacctaccgttaacgttccgtttactacttacgtacccgtttcccg

SEQ ID NO: 102567 - DNA, 183 bp, Homo sapiens
  misc_feature: GYAE6OF02HKIEK.51.83.H06.1.454.CMB.1.raw
  modified_base (109)..(109): a, c, t, g, unknown or other
  misc_feature (109)..(109): n is a, c, g, or t
  modified_base (134)..(134): a, c, t, g, unknown or other
  misc_feature (134)..(134): n is a, c, g, or t
  modified_base (138)..(183): a, c, t, g, unknown or other
  misc_feature (138)..(183): n is a, c, g, or t
tcagcgatcgtatacacgaccggtgctcgatttagatcacgtgcgtcggcgggggagaactgctcagtaggacccagagggaaccatgggaagccccagctcagcttcncttcctctgctactctggctcccanagtnnnnnnnnnnnnnnnnnnnnnnnnnnnnnnnnnnnnnnnnnnnnnn

SEQ ID NO: 102568 - DNA, 684 bp, Homo sapiens
  misc_feature: GYAE6OF02H3I0V.51.83.H06.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagcgatcgtatacacgaccggtgctcgatttagatcacgtgcgtcggcgggggaggaactgctcagttaggacccagagggaaccatggaagccccagctcagcttctcttcctcctgctactctggcctccagatgccaccgganaaattgtgttgacacagtctcagtcaccctgtctttgtctacgagggaagngacccaccctntccgtgcgacgggccagtcagagtactaagacgcgtacttacgcctaggtaccagaccaacggaaacctcggaccacggtcctcccgaggcctcctctattactagtcggtcactacgtcccaccggacgggaccctacgtcgggacctaccgtcccgacgtccgtaacggttccgaggttcggacgtaaggggttcggtacggtagggtaaccctagtaccgtcgtactacgtccaacgtctcgacgactacgtcgtacgaacgccgtagtaagttacttgacttagttttaacttgttacgactagaccagaaccgtaaagtacgtaccgtaccgttacgttaccggacgtttaccggaccgtaaacgggtacgtaagggtaacgtaaccgtaacgtaacggtaacgttggtaccgtagtaccggacctaccggttacgttaccgttccgtaacctttcgaccgtttacccg

SEQ ID NO: 102569 - DNA, 787 bp, Homo sapiens
  misc_feature: GYAE6OF02G4QIE.51.83.H06.1.454.CMB.1.raw
  modified_base (136)..(136): a, c, t, g, unknown or other
  misc_feature (136)..(136): n is a, c, g, or t
tcagcgatcgtatacacgaccggtgctcgatttagatcacgtgcgtcgcgggggaggaactgctcagttaggacccagagggaaccagtggaagccccagctcagcttctcttcctcctgctactctgctccagangccaccgataagttgtgttgacactgtcctccgagtcctacccgttgttccgtttcgtccgtacggaacggggtaacgacgacccctacccgtccgtccgtcggacgaccgggcctaaggtcgagtaacgttacgtaacgacgacgtacgtacgccgtacgtaccgacgtacaacgtaacgtcggaccgtacggccgtacccgaggtccctaccgtactactcgttacgtacggtcgcctacgtaccccgaccggaccgggccgtacgccggtctaccgcccgacgtccgtacggttacagggcgtacgggtggttccgggacgtcggacgtacgtaccgttccgaccgttaccaccgacgtaccgtccgtaagacccgaacggtacccggttgggaacctaccggtaagttaaggttcgtttaggttaaccgttttagttactttacggttccgaggtaacgcgtaaaggaacccttaaacgcccggttacgttacccggtacgtttacgggtacccggttaaccggtacgggtaaaccggtacgggtaacgggacggtaaacgtaccgaacggtaacccggtggttaaccgccgtacgaaccgtacttacccgggtactttccggttaccgtacttcccgtacccccgg

SEQ ID NO: 102570 - DNA, 700 bp, Homo sapiens
  misc_feature: GYAE6OF02JBCLR.51.83.H06.1.454.CMB.1.raw
  modified_base (199)..(200): a, c, t, g, unknown or other
  misc_feature (199)..(200): n is a, c, g, or t
  modified_base (675)..(675): a, c, t, g, unknown or other
  misc_feature (675)..(675): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatcgccaaccggacaaattgtgttgacacagtctccagtcacctgtctttgtctcaggggaaannccaccctctcctagcaggccagtcagatataacagcgacttagcctaggtaaccagacaagaaaccgtcggaccaaggcctaccccgaggtccttccttacacttacgtaacgtggtacgcgtaactaccccgaacccgacggacctaccgttaggaccaccgtacccgacggtccgtaaggttcgacggtggtaccgagggttcggggtccaaggggacctaacgggtccttacgccttcgacctaacctagtacacgactaaccgtccaaagggtaccgtacctaagggtaaactttcgtttacgacgtttaaaggtttttaacttaggttcgtacgtaagggaccttaaggaaccgtaaacgaaccgtttccggaaccgttttcggttacggtaacccgtttcggaaccgaaacggtaccgaaacgggtacgaactacggaaaccgttagtcgtagccctagactaaccgtnttaccttcgtaccttacgacttccg

SEQ ID NO: 102571 - DNA, 592 bp, Homo sapiens
  misc_feature: GYAE6OF02IRS37.51.83.H06.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcacctgtctttgtctccaggggaaagngccaccctctcctgcagggccagtcagagtataacngcgacttagctggtaccagcagaaacctggccaggcctccaggctcctacatctatggtgacatccacgacggccacgtgcatcccagccgaggtacaggtgctaggtgggtctagggacagacttcgctcgtccaacgatcagcacgtacctaagcgacgtagaagttactttagacttagtttattattgtacaagcaacggacgaaaacgtaacgtcgacccgttcgttacggaccgttacggaaccgaaacgggtaaccgaaaggttagggaaacttacgaaaaccgtaacgtaggtaacggtcgttaggacctaaccgtacgttaccgtgttaccttacgtactttaccccg

SEQ ID NO: 102572 - DNA, 698 bp, Homo sapiens
  misc_feature: GYAE6OF02JA5AX.51.83.H06.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
tcagcgatcgtatacacgaccggtgctcgatttagatcacgtgcgtcgcgggggaggaactgctcagttaggacccagagggaaccatggaagccccagctcagcttctcttcctcctgctactctgctcccagatgccaccggactaaattggtgttgacacagtctccagtcaccctgtctttgtctccgaaggggaanagcccaccctctccgtgcagggccagcagagtacttaacgagcgtacttagccgtaggtaccagcaaggaaacctggccacggtccacccaggcctccncaatcgtagtggtcncgactccaccgacggcccacgtcggcaacctccgacgacctaggttaccgnggtcggctagggtcgggtcgtacgggctacggtccttacggcctactccactaatccaacgtccgacgtaccgtagccgccgtagtaaggttctttaacgcgtttaagtttacttagttaccgttcgtaacggcgtaacgaacccggtaaaacgttaccggtccggtacccgtttcccgttaggggtacccggtttaccgggtaacccgaaaccgggtaagggaacccgggttaagaaccggttaaaccgaacgggtacccggtttaaagggcggtaacgttccgtacggaaccgttctaccggtcgttaaccgtttcaacccgtttccccg

SEQ ID NO: 102573 - DNA, 143 bp, Homo sapiens
  misc_feature: GYAE6OF01CX52G.4.12.B01.1.454.CMB.1.raw
  modified_base (128)..(143): a, c, t, g, unknown or other
  misc_feature (128)..(143): n is a, c, g, or t
tcagagcactgtagcacgaccggtgctcgatttagtagtgtagattccgcgggctggcaaggcgcatagctgcctggtcaaggactacttccctacagtgctctgagcgggctggcaaggcgcatagnnnnnnnnnnnnnnnn

SEQ ID NO: 102574 - DNA, 133 bp, Homo sapiens
  misc_feature: GYAE6OF01BYUY5.4.12.B01.1.454.CMB.1.raw
  modified_base (128)..(133): a, c, t, g, unknown or other
  misc_feature (128)..(133): n is a, c, g, or t
tcagagcactgtagcacgaccggtgctcgatttagtagtgtagattccgcgggctggcaaggcgcatagctgcctggtcaaggactacttccctacagtgctctgagcgggctggcaaggcgcatagnnnnnn

SEQ ID NO: 102575 - DNA, 132 bp, Homo sapiens
  misc_feature: GYAE6OF01AZILZ.4.12.B01.1.454.CMB.1.raw
  modified_base (128)..(132): a, c, t, g, unknown or other
  misc_feature (128)..(132): n is a, c, g, or t
tcagagcactgtagcacgaccggtgctcgatttagtagtgtagattccgcgggctggcaaggcgcatagctgcctggtcaaggactacttccctacagtgctctgagcgggctggcaaggcgcatagnnnnn

SEQ ID NO: 102576 - DNA, 132 bp, Homo sapiens; identical to SEQ ID NO: 102575
  misc_feature: GYAE6OF01B4PLM.4.12.B01.1.454.CMB.1.raw
  modified_base (128)..(132): a, c, t, g, unknown or other
  misc_feature (128)..(132): n is a, c, g, or t

SEQ ID NO: 102577 - DNA, 132 bp, Homo sapiens; identical to SEQ ID NO: 102575
  misc_feature: GYAE6OF01B58RO.4.12.B01.1.454.CMB.1.raw
  modified_base (128)..(132): a, c, t, g, unknown or other
  misc_feature (128)..(132): n is a, c, g, or t

SEQ ID NO: 102578 - DNA, 152 bp, Homo sapiens
  misc_feature: GYAE6OF02GG21Y.4.12.B01.1.454.CMB.1.raw
  modified_base (128)..(152): a, c, t, g, unknown or other
  misc_feature (128)..(152): n is a, c, g, or t
tcagagcactgtagcacgaccggtgctcgatttagtagtgtagattccgcgggctggcaaggcgcatagctgcctggtcaaggactacttccctacagtgctctgagcgggctggcaaggcgcatagnnnnnnnnnnnnnnnnnnnnnnnnn

SEQ ID NO: 102579 - DNA, 141 bp, Homo sapiens
  misc_feature: GYAE6OF02IHN1U.4.12.B01.1.454.CMB.1.raw
  modified_base (128)..(141): a, c, t, g, unknown or other
  misc_feature (128)..(141): n is a, c, g, or t
tcagagcactgtagcacgaccggtgctcgatttagtagtgtagattccgcgggctggcaaggcgcatagctgcctggtcaaggactacttccctacagtgctctgagcgggctggcaaggcgcatagnnnnnnnnnnnnnn

SEQ ID NO: 102580 - DNA, 273 bp, Homo sapiens
  misc_feature: GYAE6OF01CNE9D.41.23.C01.1.454.CMB.1.raw
  modified_base (229)..(273): a, c, t, g, unknown or other
  misc_feature (229)..(273): n is a, c, g, or t
tcagtctatactatcacgaccggtgctcgatttagtacacgtgatttagggattgggggaagaggaaggtactgacggtcctccctaaggagttcaggtgctgggcaccttgggcacgggggaggtgtggtcacaagatttgggctcgtgggcacagcggccctgggctgccctggtcaaggactacttcctatatactgtctgagcgggctggccaaggcgcagtagnnnnnnnnnnnnnnnnnnnnnnnnnnnnnnnnnnnnnnnnnnnnn

SEQ ID NO: 102581 - DNA, 422 bp, Homo sapiens
  misc_feature: GYAE6OF01BTLIL.41.23.C01.1.454.CMB.1.raw
  modified_base (419)..(422): a, c, t, g, unknown or other
  misc_feature (419)..(422): n is a, c, g, or t
tcagtctatactatcacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggccaggggaccgcggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcaatagnnnn

SEQ ID NO: 102582 - DNA, 523 bp, Homo sapiens
  misc_feature: GYAE6OF01CS9MG.41.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
  modified_base (520)..(520): a, c, t, g, unknown or other
  misc_feature (520)..(520): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacgaaaagggggnacggcccctaaggtcctcgtctctcgtgaaaccagactggaaggtagagtcccgtcaggttcagtgccagtccaggtggtggccgagtccactctcacnttagcgacctgcgctgaagntctgctaacttatttctgtcagcagtatcatagtcgtccccgttntacgttttggcctaaggggaccaaggctaggaaactacaaacgactgtagctgcaccntctgtcttcacttccttcccgcatctgntaa

SEQ ID NO: 102583 - DNA, 573 bp, Homo sapiens
  misc_feature: GYAE6OF01B4APR.41.23.C01.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggngaggcccctaaggtcctcgtctctcgtgaaacccngactggaaggtagagtcccgtcaggttcagtgccagtccaggtggtgggccggagtccactctcaccattagcgacctggcggcctgaagtattctgctaactttatttctgtcagcagtatcatagtcgtccccgtttctacgttttcggccgtaggggacccaaggtcgtaggaaactacgaaacgtacgtgtgggctcggacctaccgtacttcttacggttctttcctacttcccgtttccccgaccctattcctgtattaacg

SEQ ID NO: 102584 - DNA, 572 bp, Homo sapiens
  misc_feature: GYAE6OF01CJ9GU.41.23.C01.1.454.CMB.1.raw
  modified_base (241)..(241): a, c, t, g, unknown or other
  misc_feature (241)..(241): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaaacgaaaaagggggagaggcccctaaggtcctcgtctctcgtagaaaccagactggaaggtagacgtcccgtcaggttcagtcgccagtccgagggtggtcggggccggagtcccacgtctcacctagtacgcgacctggccggtccctagaacgtattctgactaactttatttcgtgtcagctagtatactatacgtcgtccccgtttcacgttttcggaccgtacgggacctaaggctaggaaactacgaaacgacgtagtggctcgacacctatcgtagtcttcattccttcccgactattctgattac

SEQ ID NO: 102585 - DNA, 569 bp, Homo sapiens
  misc_feature: GYAE6OF01B5YKO.41.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (564)..(564): a, c, t, g, unknown or other
  misc_feature (564)..(564): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggttacaacgaaaagggggnaggcccctaaggtcctcgtctctcgtagaaccngactggaagtagacgtcccgtcaggttcagtgccagtccgagggtggcggggccggagtccacgttcacaccattacggcctaccgtgccggcctagaagtacttctcgtactaactttatttcgtgtcagctagtatctatacgtcgtccccgtttctacgttttcggaccgtaacggggaccaaggtcgtaggaaactacgaaacgtacgtgtggctgaccacgtctctgttcttctacttccttcccgctatctgtnttaac

SEQ ID NO: 102586 - DNA, 653 bp, Homo sapiens
  misc_feature: GYAE6OF01CP12D.41.23.C01.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaagaaaaggggnacggccctaaggtcctcgtactctcgtacgaaaccaggactagggaaggtacgacggtccccgtacgtaggttccagttcgaccctaggtcccgagggtgggtcggggccgagtccacgtcctcacctagttacgccgacctggccggcctaggaacgtcttcgtgtacctaaacttttactttctagtaccgaggtctaagtactacgtatacgtccgtccccgtttataccgttttcggccgtaaggggaccctaaggccgtaggtaaaacttaccgaaaacgtacgtaggtcggtacgtacgtccgtaaccgtactccgtttacgtccccgtttacaccttttacccgttccccgtaccttattccctaagtaactttaac

SEQ ID NO: 102587 - DNA, 719 bp, Homo sapiens
  misc_feature: GYAE6OF01CDYVF.41.23.C01.1.454.CMB.1.raw
  modified_base (381)..(381): a, c, t, g, unknown or other
  misc_feature (381)..(381): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtacaccatcacgttcggccgggtcgaggttccgtagggttcgttttcgggtgtcgttggttgtccgttggtttaacgaaaacggtaaaaagggggcgaacggtacccgtaaggtcctcgtactcgtacgacgaaacctagacgtaggaaggtacgtacgtcccgtacgtaggtcaggtcnccgagtcgagggtggtcgggaccgagtccactcgtactacctagtacgacgtaccgtggccggtaccgtagaacgtcttaccgtcgttaactaactttgttcgtagttacaacggtactagttaactcgtaacgttccgtaccgtcccccgtttaagttaccggttttaccgggacccggtaacgggtaacccgtaacggtaccgtaaacggtaaacgtaacccgaaacggtacggtacgggtgacctaccgacccgtaacgtcgttaccggtctttacccttaccgtaaccgttcccctttaaccccggacttacgtttactagtttaacgttaccg

SEQ ID NO: 102588 - DNA, 624 bp, Homo sapiens
  misc_feature: GYAE6OF01CHBYU.41.23.C01.1.454.CMB.1.raw
  modified_base (269)..(269): a, c, t, g, unknown or other
  misc_feature (269)..(269): n is a, c, g, or t
  modified_base (416)..(416): a, c, t, g, unknown or other
  misc_feature (416)..(416): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttggtgctgtgcctggttcaaacgtaaaagggggnaggcccctaaggtcctacgtctctcgtagaaaccaggacctgggaaggtagacgtcccgtccgaggttcagtcgaccagtccagggtcggtcgggccggacgtccaactctcaccattacgccgacctggcggtacctaggaaagtnttctagacctaactttactttcgtgtacagtcctaaggtactactaagttacggtccgtacccccgtttactacgtttttcgggaccgtaacggggaacccaagtacgtaggaaacttacgaaacgtacgtacggtcggactggacctacgtacttcgttacgttccttctaccttccgttaccccgacctataccgttagattaaac

SEQ ID NO: 102589 - DNA, 726 bp, Homo sapiens
  misc_feature: GYAE6OF01D6B2O.41.23.C01.1.454.CMB.1.raw
tcagtctatactatcacgaccggtgctcgatttagtacacgtgattagggattgggggagtcagaccctgtcaggggacagcatggacatgagggtccccgctcagctccgtggggcctcctgctgctctggcctcccgaggttcgagtatgtgacagtcgagatcgaccaagtcctccttccttcctgttcttcttcgtggttggacgcacgccgtccacctatcctacgttcggccgggcgtagtcgtacggtttccgtttcggtgtcgttggttcgtccgtttacggttaaccgaaaacgggtaaaaagggggcgtaaccggtaccccgttaacggttccctacggttcctaccgttacgtaacggaaaccgagtacggtagggtaacggtacgtaccggttccccgtacgtacggttacacgtcgaccgtacggtccggtagggttcggggccgggaccggtacgtacccgtactcccgtactaccgtagttaccggaccgtaccgtcggaccggtccgtagtaacgttacttacgtacgtaccttaactttgttacgtcgtacgagtactagtactccgtagtccgttcccgttcccgttacgttacgttacggacggtacggtacacggtacgtagtaaactacgaacgtacgtgacgtctacgacctacgtcttcctagttcctacgtccttaccgtcccgatagtactagtacttacg

SEQ ID NO: 102590 - DNA, 555 bp, Homo sapiens
  misc_feature: GYAE6OF01BK24B.41.23.C01.1.454.CMB.1.raw
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
tcagtctatactatcacgaccggtgctcgatttagtacacgtgattagggattggggaagtcagccataatggaagcaccagctataacccgtcctcaagagtcgactcaccatctccgtcgacacgtcaagagacagatcgtccctgagtctgacgtctgtgaccgcgcggacgcggctgtgtatttctgtgcgagacggccctggtaccagcgagtggtacctgtactactactctcgtggtacgtcgtggggaccgaggggaccgcggtcaccgtcctcctcgacgcctaccaaccgaacggccagtccgtccttccccgtgcctaccctcctaccaagacgacctaccgtcgtcggggacctacgacggccgtccgtaggtcctcgccgtggacgtaacggaccttacgtcctaatacgttacgtgtcgtgacggcgtgtcggacgaaggtcgtagtaacgttggntacgtgngacgtctagcagtgacgagnacggnacgtncgtncgcgcgcgtacgcacgacgcgncncgcgcncncacnncngngcg

SEQ ID NO: 102591 - DNA, 480 bp, Homo sapiens
  misc_feature: GYAE6OF01BIMWP.41.23.C01.1.454.CMB.1.raw
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
  modified_base (454)..(480): a, c, t, g, unknown or other
  misc_feature (454)..(480): n is a, c, g, or t
tcagtctatactatcacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtcaccggtctcctcagcctccaccgaacgggccccagtccggtccttcccccgtggccgccctgctccaggacnccacctcgtcgggggcacgacggccggcccgtggggcctggcccgtgggtccaaaggtctaccgttcccacgtctactgctgacggcgggctgggcaagggcacgatagnannnnnnnnnnnnnnnnnnnnnnnnnnn

SEQ ID NO: 102592 - DNA, 509 bp, Homo sapiens
  misc_feature: GYAE6OF02IZ074.41.23.C01.1.454.CMB.1.raw
  modified_base (269)..(269): a, c, t, g, unknown or other
  misc_feature (269)..(269): n is a, c, g, or t
  modified_base (391)..(391): a, c, t, g, unknown or other
  misc_feature (391)..(391): n is a, c, g, or t
  modified_base (482)..(482): a, c, t, g, unknown or other
  misc_feature (482)..(482): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacaaaagggggnaggcccctaaggtcctcgtctctcgtgaaccagactggaaggtagagtcccgtcaggttcagtgccagtccaggtggtgggccggagtccactctcaccattagcgacctgcggcctgaagnttctgcaacttatttctgtcagcagtatcatagtcgcccgttcacttttggcctagggaccaagctaggaatcaaacgactgtgctgcacntctgtctcattcttccgccatctgata

SEQ ID NO: 102593 - DNA, 522 bp, Homo sapiens
  misc_feature: GYAE6OF02GWQPR.41.23.C01.1.454.CMB.1.raw
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattctttttatccgttactacgttttggacctaggggtacctaagcgtggaagatacgaaggactggtggctgctacatctgtcttcattcctcccgtcc

SEQ ID NO: 102594 - DNA, 608 bp, Homo sapiens
  misc_feature: GYAE6OF02HQ4S1.41.23.C01.1.454.CMB.1.raw
  modified_base (275)..(275): a, c, t, g, unknown or other
  misc_feature (275)..(275): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaaacgaaaaagggggngacggcccctaaggtcctcgtctctcgtagaaaccagactggaaggtagacgtcccgtccgaggttcagtgccagtccagggtggtgggccgngtccactctcaccatagcgacctgcggcctgaagtnttcngactaactttatttctgtcagctagtatnatagtcgtccccgtttntacgttttcgggcccgtagggggacccaaggtacctaggtaaactacgaaaacggtactagggtcggtactcgaccaaccgtacttccgttaggttcctttactaccgtttcccctttaccccggacccttaacgttcccttaggtatttaacg

SEQ ID NO: 102595 - DNA, 223 bp, Homo sapiens
  misc_feature: GYAE6OF02GWZ09.41.23.C01.1.454.CMB.1.raw
  modified_base (219)..(223): a, c, t, g, unknown or other
  misc_feature (219)..(223): n is a, c, g, or t
tcagtctatactatcacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 102596 - DNA, 660 bp, Homo sapiens
  misc_feature: GYAE6OF02HMKBT.41.23.C01.1.454.CMB.1.raw
tcagtctatactatcacgaccggtgctcgatttagtacacgtgattaggggattgggggagtcagaccctgtcaggggacagcatggacatgagggtccccgctcagctcctggggctcctgctgctctggctccaggttcgagatgtgacatcgagtaatgacccagtctccttccgttcctgtcttcttctgttggagcagcgtcaccatcacttcggccggggcgagtcaggttcgttttcggtgtctgttgccttggtttacaaacgtaaaaagggggcacggtacccctaaggtcctacgtctcgtcgtacgaaaccagacgtaggaacggtacgacggttcccggtaccgagggttccaggttcgacctacgttcctagggtgggtcgggaccggtagtaccacgtctccaactattacggccgaaccgtggccggtacctaggaacgtactttcgtacgtactaaacgtttactttcttacgtacacgtactaagttactactagtacgtacgtaccccgttactaccgttttcggaccgtacggggaaccaaggtcgtaggtaaactacgaaacgtactgtacgctcgactaccgtaagttccgttacgtccttacacgttccttacccgacttacgttctacggtattacg

SEQ ID NO: 102597 - DNA, 518 bp, Homo sapiens
  misc_feature: GYAE6OF02F5LG6.41.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (483)..(483): a, c, t, g, unknown or other
  misc_feature (483)..(483): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgtcgggcgagtcaggtcgttttcggngctgttgcctggtttcaacaaaaagggggngaggcccctaaggtcctcgtctctcgtgaaaccagactggaaggtagagtcccgtccaggttcagtgccagtccaggtggtgggccggagtccactctcaccattagcgacctgcggcctgaagattctgcaacttatttctgtcagcagtatcatagtgccccgttcacttttggccaggggaccaagctaggaaatcaaacgaactgtgntgcaccatctgtcttcatcttcccgccatctgata

SEQ ID NO: 102598 - DNA, 550 bp, Homo sapiens
  misc_feature: GYAE6OF02HC9QO.41.23.C01.1.454.CMB.1.raw
  modified_base (298)..(298): a, c, t, g, unknown or other
  misc_feature (298)..(298): n is a, c, g, or t
  modified_base (395)..(395): a, c, t, g, unknown or other
  misc_feature (395)..(395): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatctttcnggatccactttgaagagtggagtcccagccaggttcagcggcagtggttctgggacacgtatttcactctcaccatcagcagcctgcagcctggatnttcgcgtacttattacgtgaccaactaattactttctttttactccgttactagttttcggaccgtaaggggacctaaggcttagggagtagttacgaaaggtacgtggtacggctagaccgactatacttcgttcttacgtacttccttacccg

SEQ ID NO: 102599 - DNA, 579 bp, Homo sapiens
  misc_feature: GYAE6OF02H1904.41.23.C01.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
  modified_base (543)..(543): a, c, t, g, unknown or other
  misc_feature (543)..(543): n is a, c, g, or t
tcagtctatactatcacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtcctccttccttcctgtcttcttctgttgaggcagcgtcaccatcacttgccgggcgagtcaggtcgttttcggngctgttgccttggtttacaaacgaaaaagggggngacggacccctaaggtcctcgtctctcgtacgaaaccagacgtggaaggtagacgtcccgtcaggttcagtcgccagtccagggtggtgggccgagtccactctcaccattacgcgacctgcgcctgaacgcttcngactaatttatttctgtcagcagtatctatcgtctcccgtttntacgtttcggacgtacggggtaccaacggtcgtaggaaactacgaaacgtaactggtacgcgtacgcctaacgtactccttgtacccttnacctttccctcccgtacctacttcgtagtattaacg

SEQ ID NO: 102600 - DNA, 863 bp, Homo sapiens
  misc_feature: GYAE6OF02ITKWR.41.23.C01.1.454.CMB.1.raw
  modified_base (351)..(351): a, c, t, g, unknown or other
  misc_feature (351)..(351): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttcctcctgtcttctctgttggagcagcgtcaccatcacttcggccgggcgtagtcgacggttcggttttcggtgtcttggttcgccgtttggtttacaaaacggtaaaaagggggggataaccgggtacccccttaaagggtccccttcggtcttccgttacggtacggaaaacccgngacgtagggaagggttagacggttccccgtaccgagggttctaagtcgacccgtagtccggaggggttcgggtcggggccggtaacgttcccacgttacctccggaaccctagttacggccgtaaccgtgtacccggggtaccttagggaacgttaccttttcgacggtaacccgttaaaacctttttcgttttacccgtacggttacctaacggtacctaacggttacttaccgtaaggtttaaccggttccccggttacccccgttttacggttacccggttttttaccgggaacccggggttaaaccggggggaaacctaacgggtaccgggtaaacggggtaaaaccttaacccggtaaaaacgggtaaccggttacggggttacgtaccggtcggtaacccgtaaacccggttctttacccgtttaacggtcccttttaaccgtacccgttttacccctttacccccggacttaacccgttttactttaacgggtactttaaaccgg

SEQ ID NO: 102601 - DNA, 757 bp, Homo sapiens
  misc_feature: GYAE6OF02FPP03.41.23.C01.1.454.CMB.1.raw
tcagtctatactatcacgaccggtgctcgatttagtacacgtgattagggattggggagtcagaccctgtcaggggacagcatggacatgagggtccccgctcagctcctggggctcctgctgctctggctcccaggttcgagatgtgacatcgagatcgacccagtctccttccttcctgtcttcttctgttggagcagcgtcaccatcacttcggccgggcgagtcgtagggttcgttttcggtgtctgttcgccgttggtttacaaaacggaaaagggggagacggaccccgtaaggtcctcgtctctcgtacgaaccagacgtagggtaaggtacgtacgtccccggtcgtagggtttccaggtccgaccgtacggttcccgaggggttcgggtcggggcccggtacgttcccaccttcctaccgactagttacggcccgtaccgtcggcccggtccgtagaacgttacgtttccgtacgtaccttaaaccttttcttttccgtgtacctaagtcctaagttactacttaacttaccggttcccgttaccccgtttacgttaccgtttttaccgggacccggtaacgggggtaaccctaacggtaccgttaacggtaaactacccgtaaaaccgtacgtcgggtacgtaccggtacctaccgtacccgtacgtttaccgttacgttcctttaccgttaccgtttccccgttaccccgtccctttaacgttaccgtttacggttaactttaacg

SEQ ID NO: 102602 - DNA, 882 bp, Homo sapiens
  misc_feature: GYAE6OF02JZGLT.41.23.C01.1.454.CMB.1.raw
  modified_base (247)..(247): a, c, t, g, unknown or other
  misc_feature (247)..(247): n is a, c, g, or t
tcagtctatactatcacgaccggtgctcgatttagtacacgtgattagggagttgggggagtcagaccctgtcaggggacagcatggacatgagggtccccgctcagctccgtggggctcctgctgctctggctcccgaggttcgagatgtgacatcgagatcgacccagtcctccttccttcctgtcttcttctgttggagcagcgtcacatcacgttcgccggcgagtcgaggttcgttttcggntcgttgttcgtccgttaggttaccgaaaacggaaaagggggtcgacggtacccgtaacggtccgtacgtctacgtcggtaacgaacccgtagtacgtaggtaacgtacgaccggtccgtaccgtaggttacacgttcaccgtagttccggaaggttcgggtcggaccggtagtcccgtatcgtaccgaactacgttacgaccgtacgtacggccggtaccgtaagaaacttcgttcctagtaaccctttaaagttttcgttactacgggtactaacggtataaacgttcgttacttaaccggttaaccggttccccgggttacccccgtttaagtttaccgggttttacccggggaacccgggtaaacggggggttaaaccccctaacgggtttacgggtttaaaaccgggtaaaaacccggttaaaccggttaaaaaaacccggggttcgtaaccggggggttttcccggtaaacccggttttaacggacccccggtttaaaaccccggtttaattttccgggttaccgggttttaaacccccttttaggggtaaacccccctttttaccccggggttcccccaaaacccgttttaggtttaaccccggtttaacgtaaacggttttaaacccg

SEQ ID NO: 102603 - DNA, 477 bp, Homo sapiens
  misc_feature: GYAE6OF02I5NVJ.41.23.C01.1.454.CMB.1.raw
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (443)..(477): a, c, t, g, unknown or other
  misc_feature (443)..(477): n is a, c, g, or t
tcagtctatactatcacgaccggtgctcgatttagtacacgtgattagggattggggaagtcagccataatggaagcaccagctataacccgtccctcaagagtcgactcaccatctccgccgacacgtccaagagaccagatgtccctgagtctgacgtctgtgaccgccgcggacgcggctcgtgtattctgtgcagacggccctggtccagcgagtcggtacctctaacgtactactctctacgggacgttcgtggggccagggggcccgtgggtccacgtccgtcctcacgcctccgaccaacgggcccagccggttccttcccccgtgcccaccctcctcccaagngtccactcgtaggggcacnggcgtccgtggctcgctgcagctcgtcngncgntcngcgnggtctggactacggcgctaacgtgcnanctgcnnnnnnnnnnnnnnnnnnnnnnnnnnnnnnnnnnn

SEQ ID NO: 102604 - DNA, 704 bp, Homo sapiens
  misc_feature: GYAE6OF02H5ZWQ.41.23.C01.1.454.CMB.1.raw
  modified_base (278)..(278): a, c, t, g, unknown or other
  misc_feature (278)..(278): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacatcacttcggccgggcgagtcagggttcgttttcggtgctgttcgccttggtttacaaacgaaaaagggggngacggacccctaaggtcctcgtctctcgtagaaaccgagtacgtaggaaggtagaccggttcccgtccaggttcacggttcgaccgtacggtccgagggtcgggtcgggccggtacgtcctacttcctccacctagttacgccgtacctcggcggtcctaggaagttcttccgacgtaccttaaacttttctttccgttagtccgagtacctagttacgtactacgttacggtcccgttaccccgtttacttaccggttttcgggtaccggaaaccggggtaaccctaaggtaccgttaaggaaacttaaccgaaaacgtacgttacggtcggactcggaccaaccgttcttccgttacgttaccttaccgtacccgttttccccgttaccccggtaccttacgttacgttacttaaacgtttacg

SEQ ID NO: 102605 - DNA, 236 bp, Homo sapiens
  misc_feature: GYAE6OF01DWRCW.29.11.A11.1.454.CMB.1.raw
  modified_base (235)..(236): a, c, t, g, unknown or other
  misc_feature (235)..(236): n is a, c, g, or t
tcagatagagtactcacgaccggtgctcgatttagctacgactgcagggtagctggaatttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnn

SEQ ID NO: 102606 - DNA, 239 bp, Homo sapiens
  misc_feature: GYAE6OF01AR85G.29.11.A11.1.454.CMB.1.raw
  modified_base (237)..(239): a, c, t, g, unknown or other
  misc_feature (237)..(239): n is a, c, g, or t
tcagatagagtactcacgaccggtgctcgatttagctacgactgcagggtagctggaattttgagtcctggggccagggaaccctggtcatcgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnn

SEQ ID NO: 102607 - DNA, 239 bp, Homo sapiens
  misc_feature: GYAE6OF01CWT8J.29.11.A11.1.454.CMB.1.raw
  modified_base (236)..(239): a, c, t, g, unknown or other
  misc_feature (236)..(239): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggcctgggctgcctggtcaaggactacttccacatacgtcactgagcgggctggcaaggcgcatagnnnn

SEQ ID NO: 102608 - DNA, 239 bp, Homo sapiens
  misc_feature: GYAE6OF01EDQ58.29.11.A11.1.454.CMB.1.raw
  modified_base (236)..(239): a, c, t, g, unknown or other
  misc_feature (236)..(239): n is a, c, g, or t
tcagatagagtactcacgaccggtgctcgatttagctacgactgcagggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnnnn

SEQ ID NO: 102609 - DNA, 244 bp, Homo sapiens
  misc_feature: GYAE6OF01DYPQ1.29.11.A11.1.454.CMB.1.raw
  modified_base (193)..(194): a, c, t, g, unknown or other
  misc_feature (193)..(194): n is a, c, g, or t
  modified_base (197)..(244): a, c, t, g, unknown or other
  misc_feature (197)..(244): n is a, c, g, or t
tcagatagagtactcacgaccggtgctcgatttagctacgactgcgaagggaaaggggtgagatacctcgctgtggctcactttcggcggagggaccaaggtggacatcaaaggaactggtggctgcaccatctcgtcttcatcttcccgcatctgatctctcgactctgagcgggctggcaaggcgcatagnngcnnnnnnnnnnnnnnnnnnnnnnnnnnnnnnnnnnnnnnnnnnnnnnnn

SEQ ID NO: 102610 - DNA, 241 bp, Homo sapiens
  misc_feature: GYAE6OF01D3H7V.29.11.A11.1.454.CMB.1.raw
  modified_base (237)..(241): a, c, t, g, unknown or other
  misc_feature (237)..(241): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnnn

SEQ ID NO: 102611 - DNA, 245 bp, Homo sapiens
  misc_feature: GYAE6OF01A6L1F.29.11.A11.1.454.CMB.1.raw
  modified_base (235)..(245): a, c, t, g, unknown or other
  misc_feature (235)..(245): n is a, c, g, or t
tcagatagagtactcacgaccggtgctcgatttagctacgactgcaggggtagctggaattttgagtcctgggccagggaaccctggtcatcgtctcctcagcctccaccaagggcccatcggtcttcccctggcgccctgctccaggagcacctccgagagcacagcggccctgggctgcctggtcaaggctacttccacatacgtcactgagcgggctggcaaggcgcatagnnnnnnnnnnn

SEQ ID NO: 102612 - DNA, 256 bp, Homo sapiens
  misc_feature: GYAE6OF01CXY59.29.11.A11.1.454.CMB.1.raw
  modified_base (235)..(256): a, c, t, g, unknown or other
  misc_feature (235)..(256): n is a, c, g, or t
tcagatagagtactcacgaccggtgctcgatttagctacgactgcaggggtagctggaattttgagtccttgggccagggaaccctggtcatcgtctcctcagcctccaccaaacgggcccatcggtcttcccctggcgccctgctccaggagcacctccgagagcacagcggcctggctgcctggtcaaggactacttccacatacgtcactgagcggctggcaagcgcatagnnnnnnnnnnnnnnnnnnnnnn

SEQ ID NO: 102613 - DNA, 239 bp, Homo sapiens
  misc_feature: GYAE6OF01EFQ7S.29.11.A11.1.454.CMB.1.raw
  modified_base (237)..(239): a, c, t, g, unknown or other
  misc_feature (237)..(239): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnnn

SEQ ID NO: 102614 - DNA, 246 bp, Homo sapiens
  misc_feature: GYAE6OF01AZGPF.29.11.A11.1.454.CMB.1.raw
  modified_base (197)..(246): a, c, t, g, unknown or other
  misc_feature (197)..(246): n is a, c, g, or t
tcagatagagtactcacgaccggtgctcgatttagctacgactgcaagggtaaaggggtgagatacctcgctgtcggctcacctttcggcggagggacccaaggtggacatcaaaggactgtggctgcaccatctgtcttcatcttcccgccatcttgatctctcgactctgagcgggctggctaggcgcgatagcnnnnnnnnnnnnnnnnnnnnnnnnnnnnnnnnnnnnnnnnnnnnnnnnnn

SEQ ID NO: 102615 - DNA, 241 bp, Homo sapiens
  misc_feature: GYAE6OF01CZT4D.29.11.A11.1.454.CMB.1.raw
  modified_base (238)..(241): a, c, t, g, unknown or other
  misc_feature (238)..(241): n is a, c, g, or t
tcagatagagtactcacgaccggtgctcgatttagctacgactgcaggggtagctggaattttgagtccttgggccagggaaccctggtcatcgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnn

SEQ ID NO: 102616 - DNA, 240 bp, Homo sapiens
  misc_feature: GYAE6OF01AW87G.29.11.A11.1.454.CMB.1.raw
  modified_base (237)..(240): a, c, t, g, unknown or other
  misc_feature (237)..(240): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnnnn

SEQ ID NO: 102617 - DNA, 249 bp, Homo sapiens
  misc_feature: GYAE6OF01DBNTD.29.11.A11.1.454.CMB.1.raw
  modified_base (153)..(153): a, c, t, g, unknown or other
  misc_feature (153)..(153): n is a, c, g, or t
  modified_base (241)..(249): a, c, t, g, unknown or other
  misc_feature (241)..(249): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtccttccccctggcgccctgctccaggancacctccgagagcacagccggccctgggctgcctggtcaaggactacttccacatacgtcactgagcgggctggacaaggcgcatagnnnnnnnnn

SEQ ID NO: 102618 - DNA, 244 bp, Homo sapiens
  misc_feature: GYAE6OF01CKCK2.29.11.A11.1.454.CMB.1.raw
  modified_base (237)..(244): a, c, t, g, unknown or other
  misc_feature (237)..(244): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcgccctgctccaggagcacctcgagagcacagcggccctgggctgcctggtcaaggactacttccacatacgtcactgagcgggctggcaaggcacatagnnnnnnnn

SEQ ID NO: 102619 - DNA, 244 bp, Homo sapiens
  misc_feature: GYAE6OF01C9MFU.29.11.A11.1.454.CMB.1.raw
  modified_base (238)..(244): a, c, t, g, unknown or other
  misc_feature (238)..(244): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagcnnnnnnn

SEQ ID NO: 102620 - DNA, 236 bp, Homo sapiens
  misc_feature: GYAE6OF02HIB39.29.11.A11.1.454.CMB.1.raw
  modified_base (235)..(236): a, c, t, g, unknown or other
  misc_feature (235)..(236): n is a, c, g, or t
tcagatagagtactcacgaccggtgctcgatttagctacgactgcagggtagctggaattttgagtcctgggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnn

SEQ ID NO: 102621 - DNA, 229 bp, Homo sapiens
  misc_feature: GYAE6OF02H3LF7.29.11.A11.1.454.CMB.1.raw
  modified_base (193)..(194): a, c, t, g, unknown or other
  misc_feature (193)..(194): n is a, c, g, or t
  modified_base (196)..(229): a, c, t, g, unknown or other
  misc_feature (196)..(229): n is a, c, g, or t
tcagatagagtactcacgaccggtgctcgatttagctacgactgcgaagggaagggtgagatacctcgctgtggctcgactttcggcggagggaccaaggtggacatcaaaggaactgtggctggcaccatctcgtcttcatcttcccgccatctgatctctcgactctgagcgggctggcaaggcgcatagnngnnnnnnnnnnnnnnnnnnnnnnnnnnnnnnnnnn

SEQ ID NO: 102622 - DNA, 248 bp, Homo sapiens
  misc_feature: GYAE6OF02HUTI4.29.11.A11.1.454.CMB.1.raw
  modified_base (240)..(248): a, c, t, g, unknown or other
  misc_feature (240)..(248): n is a, c, g, or t
tcagatagagtactcacgaccggtgctcgatttagctacgactgcaggggtagctggaattttgagtccttgggccagggaaccctggtcatcgtctcctcagcctccgaccaagggcccatcggtcttcccccgtggcgccctgctccaggagcacctccgagagcacagcggccctgggctgcctggtcaaggactacttccacatacgtcactgagcgggctggcaaggcgcatagnnnnnnnnn

SEQ ID NO: 102623 - DNA, 237 bp, Homo sapiens
  misc_feature: GYAE6OF02GSOKD.29.11.A11.1.454.CMB.1.raw
  modified_base (236)..(237): a, c, t, g, unknown or other
  misc_feature (236)..(237): n is a, c, g, or t
tcagatagagtactcacgaccggtgctcgatttagctacgactgcagggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnn

SEQ ID NO: 102624 - DNA, 266 bp, Homo sapiens
  misc_feature: GYAE6OF02FF47M.29.11.A11.1.454.CMB.1.raw
  modified_base (239)..(266): a, c, t, g, unknown or other
  misc_feature (239)..(266): n is a, c, g, or t
tcagatagagtactcacgaccggtgctcgatttagctacgactgcgaggggtagctggaattttgagtcctggggccagggaaccctggtcatcgtctcctcagcctccaccaagggcccatcggtcttcccctggcgccctgctccaggagcacctccgagagcacagcggccctggggctgcctggtcaaggactacttccacatacgtcactgagcgggctggcaaggcgcatagnnnnnnnnnnnnnnnnnnnnnnnnnnnn

SEQ ID NO: 102625 - DNA, 243 bp, Homo sapiens
  misc_feature: GYAE6OF02GJ0RW.29.11.A11.1.454.CMB.1.raw
  modified_base (238)..(243): a, c, t, g, unknown or other
  misc_feature (238)..(243): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccatagcgtactctgagcgggctgggcaaggcgcatagnnnnnn

SEQ ID NO: 102626 - DNA, 249 bp, Homo sapiens
  misc_feature: GYAE6OF02IX5HD.29.11.A11.1.454.CMB.1.raw
  modified_base (198)..(199): a, c, t, g, unknown or other
  misc_feature (198)..(199): n is a, c, g, or t
  modified_base (201)..(249): a, c, t, g, unknown or other
  misc_feature (201)..(249): n is a, c, g, or t
tcagatagagtactcacgaccggtgctcgatttagctacgactgcgaagggaaaggggtgagatacctcgctgtggctcactttcggcggagggaccaaggtggacatcaaaggaactgtggctggcaccatctcgtcttcatctttcccgccatctggatctctccgactctgagcgggctggcaaggcgcaatagnngnnnnnnnnnnnnnnnnnnnnnnnnnnnnnnnnnnnnnnnnnnnnnnnnn

SEQ ID NO: 102627 - DNA, 243 bp, Homo sapiens
  misc_feature: GYAE6OF02FLJEN.29.11.A11.1.454.CMB.1.raw
  modified_base (238)..(243): a, c, t, g, unknown or other
  misc_feature (238)..(243): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcgccctgctccaggagcacctccgagagcacagcggccctgggctgcctggtcaaggactacttccatagcgtactctgagcgggctggcaaggcgcatagnnnnnn

SEQ ID NO: 102628 - DNA, 240 bp, Homo sapiens
  misc_feature: GYAE6OF02FG5TP.29.11.A11.1.454.CMB.1.raw
  modified_base (236)..(240): a, c, t, g, unknown or other
  misc_feature (236)..(240): n is a, c, g, or t
tcagatagagtactcacgaccggtgctcgatttagctacgactgcaggggtagctggaatttgagtcctggggccagggaaccctggtcatcgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnnn

SEQ ID NO: 102629 - DNA, 241 bp, Homo sapiens
  misc_feature: GYAE6OF02G512B.29.11.A11.1.454.CMB.1.raw
  modified_base (238)..(241): a, c, t, g, unknown or other
  misc_feature (238)..(241): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnn

SEQ ID NO: 102630 - DNA, 243 bp, Homo sapiens
  misc_feature: GYAE6OF02IK16T.29.11.A11.1.454.CMB.1.raw
  modified_base (238)..(243): a, c, t, g, unknown or other
  misc_feature (238)..(243): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcgccctgctccaggagcacctccgagagcacagcggccctgggctgcctggtcaaggactacttccacatacgtcactgagcgggctggcaaggcgcatagnnnnnn

SEQ ID NO: 102631 - DNA, 256 bp, Homo sapiens
  misc_feature: GYAE6OF02FUYZI.29.11.A11.1.454.CMB.1.raw
  modified_base (242)..(244): a, c, t, g, unknown or other
  misc_feature (242)..(244): n is a, c, g, or t
  modified_base (246)..(256): a, c, t, g, unknown or other
  misc_feature (246)..(256): n is a, c, g, or t
tcagatagagtactcacgaccggtgctcgatttagctacgactgcagggggtagactggaattttgagtcctggggcccagggaaccctggtcatcgtctcctcagcctccaccaagggcccatcggtcttccccctggcgccctgctccaggagcacctccgagagcacagcggccctgggctgcctggtcaaggactacttccatagcgtactctgagcgggctggcaaggcgacatagnnntnnnnnnnnnnn

SEQ ID NO: 102632 - DNA, 256 bp, Homo sapiens
  misc_feature: GYAE6OF02JATFR.29.11.A11.1.454.CMB.1.raw
  modified_base (239)..(256): a, c, t, g, unknown or other
  misc_feature (239)..(256): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcgcccctgctccaggagcacctccgagagcacagcggccctgggctgcctggtcaaggactacttccatagcgtactctgagcgggctggcaaggcgcatagnnnnnnnnnnnnnnnnnn

SEQ ID NO: 102633 - DNA, 243 bp, Homo sapiens
  misc_feature: GYAE6OF02GXRSJ.29.11.A11.1.454.CMB.1.raw
  modified_base (237)..(243): a, c, t, g, unknown or other
  misc_feature (237)..(243): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacagcggccctgggctgcctggtcaaggactacttccacatacgtcactgagcgggctggcaaggcgcatagnnnnnnn

SEQ ID NO: 102634 - DNA, 194 bp, Homo sapiens
  misc_feature: GYAE6OF02HFL68.29.11.A11.1.454.CMB.1.raw
  modified_base (190)..(194): a, c, t, g, unknown or other
  misc_feature (190)..(194): n is a, c, g, or t
tcagatagagtactcacgaccggtgctcgatttagctacgactgcaagggaaagtgtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnn

SEQ ID NO: 102635 - DNA, 319 bp, Homo sapiens
  misc_feature: GYAE6OF02IMXKT.29.11.A11.1.454.CMB.1.raw
  modified_base (154)..(154): a, c, t, g, unknown or other
  misc_feature (154)..(154): n is a, c, g, or t
  modified_base (241)..(248): a, c, t, g, unknown or other
  misc_feature (241)..(248): n is a, c, g, or t
  modified_base (251)..(251): a, c, t, g, unknown or other
  misc_feature (251)..(251): n is a, c, g, or t
  modified_base (256)..(319): a, c, t, g, unknown or other
  misc_feature (256)..(319): n is a, c, g, or t
tcagatagagtactcacgaccggtgctcgattttagctacgactgcgagggggtagctggaatttttgagtcctggggccaggggaaccctggtcatcgtctcctcagcctccaccaagggcccatcggtcttcccctggcgccctgctcaggngcacctcgagagcacagcggccctgggctgcctggtcaaggctacttcatagcgtactcgtgagcgggctggccaaggcgcatagcnnnnnnnntanctgcnnnnnnnnnnnnnnnnnnnnnnnnnnnnnnnnnnnnnnnnnnnnnnnnnnnnnnnnnnnnnnnn

SEQ ID NO: 102636 - DNA, 300 bp, Homo sapiens
  misc_feature: GYAE6OF02HBWKY.29.11.A11.1.454.CMB.1.raw
  modified_base (138)..(138): a, c, t, g, unknown or other
  misc_feature (138)..(138): n is a, c, g, or t
  modified_base (152)..(152): a, c, t, g, unknown or other
  misc_feature (152)..(152): n is a, c, g, or t
  modified_base (163)..(163): a, c, t, g, unknown or other
  misc_feature (163)..(163): n is a, c, g, or t
  modified_base (235)..(235): a, c, t, g, unknown or other
  misc_feature (235)..(235): n is a, c, g, or t
  modified_base (242)..(249): a, c, t, g, unknown or other
  misc_feature (242)..(249): n is a, c, g, or t
  modified_base (251)..(254): a, c, t, g, unknown or other
  misc_feature (251)..(254): n is a, c, g, or t
  modified_base (257)..(300): a, c, t, g, unknown or other
  misc_feature (257)..(300): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttccccctggcnccctgctccagganccacctccgangcacagcggccctgggctgcctggtcaaggactacttccacatacgcacgtgacgcgggctgggacagggcncaatgcnnnnnnnnannnnatnnnnnnnnnnnnnnnnnnnnnnnnnnnnnnnnnnnnnnnnnnnn

SEQ ID NO: 102637 - DNA, 265 bp, Homo sapiens
  misc_feature: GYAE6OF02HSQIZ.29.11.A11.1.454.CMB.1.raw
  modified_base (240)..(265): a, c, t, g, unknown or other
  misc_feature (240)..(265): n is a, c, g, or t
tcagatagagtactcacgaccggtgctcgatttagctacgactgcaggggtagctggaattttgagtcctggggccagggaaccctggtcatcgtctcctcagcctccaccaagggcccatcggtcttcccctggcgccctgctccaggagcacctccgagagcacgagcggccctgggctgcctggcaaggactacttccatagcgtactctgagcgggtctggacaaggcacagtagnnnnnnnnnnnnnnnnnnnnnnnnnn

SEQ ID NO: 102638 - DNA, 538 bp, Homo sapiens
  misc_feature: GYAE6OF01BEF0L.8.19.B08.1.454.CMB.1.raw
  modified_base (196)..(196): a, c, t, g, unknown or other
  misc_feature (196)..(196): n is a, c, g, or t
  modified_base (492)..(492): a, c, t, g, unknown or other
  misc_feature (492)..(492): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttacccaccagttagcctggtaccaacacaaacctggccaggctcccaggcccctcatcttgatgcatccatcgagggccactggcactcccagccaggttcagtggcagtgggtctgggacagtacttcactctcacctatcagcagcctagacgcctagaagtatgttgctagtttattactgtacaacatcgtaccgaggtcggccgtccggggcctacgttccggcccgtgggacgtaggtggagactacgaacgacgtgnggcgtgactaccacgtctcgttcttactacttccgttcccgctacg

SEQ ID NO: 102639 - DNA, 551 bp, Homo sapiens
  misc_feature: GYAE6OF01EC45D.8.19.B08.1.454.CMB.1.raw
  modified_base (522)..(522): a, c, t, g, unknown or other
  misc_feature (522)..(522): n is a, c, g, or t
  modified_base (547)..(547): a, c, t, g, unknown or other
  misc_feature (547)..(547): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttacgcctggtaccaacacaaacctggccaggctcccaggcccctcatctttgatgcatccatcagggccactggcatcccagccaggttcagtggcagtgggtctgggacagacttcactctcaccatcagcagcctagagcctagaagtattttgactagtttattactgtcaactattcgtaccgtagtcggcccgtccgggggcctaaccgtttccgggccccttaggggaaccctaaaagttcggaacgactacgaaacgaactgtaggcgtgacacntctgtcttcacttccttcccgcctntccg

SEQ ID NO: 102640 - DNA, 542 bp, Homo sapiens
  misc_feature: GYAE6OF01A8ZLC.8.19.B08.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
  modified_base (519)..(519): a, c, t, g, unknown or other
  misc_feature (519)..(519): n is a, c, g, or t
tcagctcgcgtgtccacgaccggtgctcgatttagtgagtcagtaagggggaggaactggctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttacgcctggtaccaacacaaacctggccaggctccctggcccctnactctttgatgcatccatcaggccactggcactcccagccaggttcagtggcagtgggtctgggacaggtactcactctcaccatcagcacgcctagacgctagaagtatttgactagtttnttactgtactaactntacgtaccgngtcggccgtccggggcctacgtttccggcccgtgggtaacctaagttgacgtactaacgaaacgaacgtgtaggcgtgcaccatctnttctctacttcttcccgctctcg

SEQ ID NO: 102641 - DNA, 540 bp, Homo sapiens
  misc_feature: GYAE6OF01ALHUU.8.19.B08.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (513)..(513): a, c, t, g, unknown or other
  misc_feature (513)..(513): n is a, c, g, or t
  modified_base (536)..(536): a, c, t, g, unknown or other
  misc_feature (536)..(536): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctnatctttgatgcatccatcagggccactggcatcccagccaggttcagtggcagtggtctgggacagtacttcactctcaccatcagcagcctagacgctagaagtatttgcttagttttattacttgtacaactatcgtaccgaggtcggccgtccggggtcctaccgtttccggcccgtacgggaacctaaagttcgaagtactacgaaacgactagtggctgcacctntctgtcttctacttcctccctcnctcg

SEQ ID NO: 102642 - DNA, 692 bp, Homo sapiens
  misc_feature: GYAE6OF01BICAH.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttccctcctgctactctggctcccagataccaccggagagattgtgttgacacagtctccagccaccctgtctttgtctccgaggggaagagccaccctctcctgcgagggccagtcagagtgttacccacccagttacgcctaggtaccaacacaaaccgtcggaccaggcctcccagacctcctcattcgtttcggccgtcctttaacgacgggccaggtacggaactcccgagccgaggttcaggcggctaggtgggtcgtgggtacctttcggttcacgttcctcacctatactaaactaacctgactaaatctacgacgttactttgacttagttttactttcgtgtacagtctagtctagaacgtacgttcgggtcccgtttacgtaccgttttcgggacgggtaacgggaaccgtaaggggttccggaaccctaacgtaaaacggtacgttgggtacggtacctggaccctaacctacgttccgttccggtttactttacctaactttcccccgtttacccccgaccgttaacttacccggttacggaaaccggaacccgtaccggtaccggtacggg

SEQ ID NO: 102643 - DNA, 530 bp, Homo sapiens
  misc_feature: GYAE6OF01EFGKV.8.19.B08.1.454.CMB.1.raw
  modified_base (505)..(505): a, c, t, g, unknown or other
  misc_feature (505)..(505): n is a, c, g, or t
  modified_base (527)..(527): a, c, t, g, unknown or other
  misc_feature (527)..(527): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcaggtggcaggtgggtctggggacagacttcactctcaccatcagcagccctagagcctgaagtatttgctagtttattactgtacaactatcgtacgagtcggccgtccggggcctacgttccggcccgtcgggaacctaaagttcgaagactacgaaacgactgtgcgtcgcacntctgtcttcactccttccctcntcg

SEQ ID NO: 102644 - DNA, 532 bp, Homo sapiens
  misc_feature: GYAE6OF01BQORZ.8.19.B08.1.454.CMB.1.raw
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagacgcccgaagatttgctagtttattactgtcaactatcgtaccgagtcggccgtccggggcctacgtttccggccctgggacctaaagttgagatacaacgtaactgtcggctcgcacactcgtcgtcttctacttcttacccncctntctacg

SEQ ID NO: 102645 - DNA, 566 bp, Homo sapiens
  misc_feature: GYAE6OF01ESEZK.8.19.B08.1.454.CMB.1.raw
  modified_base (284)..(284): a, c, t, g, unknown or other
  misc_feature (284)..(284): n is a, c, g, or t
  modified_base (552)..(552): a, c, t, g, unknown or other
  misc_feature (552)..(552): n is a, c, g, or t
tcagctcgcgtgtccacgaccggtgctcgatttagtgagtcagtaagggggaggaacttctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatcttgatgcatccatcagggccacgtggcatcccagccaggttcagtggcaggtgggtctgggacaggacttcgactctcaccatcagcagcctagacgcctagaatatttgtctagtttattactgtacaacatcgtaccgagtcggccgtccggggcctacgtttccggcccgtacgggaacctaaaagttacggaagtactacgtaaaaccgaacgtggtggactggcctaacctatcgtcgtcttactacttcccttaccccncctatccgtaacgg

SEQ ID NO: 102646 - DNA, 541 bp, Homo sapiens
  misc_feature: GYAE6OF01D5WOG.8.19.B08.1.454.CMB.1.raw
  modified_base (481)..(481): a, c, t, g, unknown or other
  misc_feature (481)..(481): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttacccacccagttagcctggtaaccaacagaaacctgccaggctcccaggctcctcatctctgatacatacccaacgacgggcccaacgtgggccatcccagccctaggttcagtggcagtgggtctgggacagacttcactctcaccatcagcacgcctagacgcctagaagtatttgactactttatctagtcagcagtcgtagttacgtgtccttcgctttacggccctagggtaacctaagtgactanacaaacgactggtgtctgaccactatcttacgtcttactactccttccccgtctagtccg

SEQ ID NO: 102647 - DNA, 573 bp, Homo sapiens
  misc_feature: GYAE6OF01DU1NJ.8.19.B08.1.454.CMB.1.raw
  modified_base (284)..(284): a, c, t, g, unknown or other
  misc_feature (284)..(284): n is a, c, g, or t
  modified_base (390)..(390): a, c, t, g, unknown or other
  misc_feature (390)..(390): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatctttgatgcatccatcaggccacgtggcactcccagcctaggttcagtggcagtgggtctgggacagacttcactctcacatcagcagcctagagcctagaatntttgacttagtttattactgtacaactactacgtacgagtcggcccggtccggggcctaccgtttccggcccgttacgggaaccctaaaagttcggaagtactaacgaaaaccggtaactaggtcggacgtcgaccacctagttacctcgttccttactacttcccttccccgtcctctaccg

SEQ ID NO: 102648 - DNA, 648 bp, Homo sapiens
  misc_feature: GYAE6OF01AUBYF.8.19.B08.1.454.CMB.1.raw
  modified_base (293)..(293): a, c, t, g, unknown or other
  misc_feature (293)..(293): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagcgtggtttcctcgttgctctttaagaggtgtccagtgtcaagtgcaactggtggagtcgtgggggggctggtccagcctgggagtccctgagactctcctgtcgcaggctcgtggattccaccttcagtaactacggcgtgcacgtgggtccnccgaggcctccgaggcaagggtcttggagtggctgggctagtttgttcatcgtaggaaggtagttgttaccaaattactaataacgacgtaccttccggtaggaaacgggccgtaatttccaacctatccgtaccaagacgtaacaacttaccaaagaacacgtaatgtactctagactaaagtcgaacacgtacctaaggtagtaggaacggacgtacggtactttagtttaacgttacgtaacggtaacggaaacggggtaggggtaacttacggaaggttgggaccgtacggtacccgtaaccgtaaagttacccttacgtttacgtaccgttcggtacggggtaaccccgg

SEQ ID NO: 102649 - DNA, 598 bp, Homo sapiens
  misc_feature: GYAE6OF01EVG7B.8.19.B08.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (565)..(565): a, c, t, g, unknown or other
  misc_feature (565)..(565): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttacgcctggtaccaacacaaacctggccaggcctccacggcccctnattctttgatgcactccatcgacggccacgtggacactcccagcctaggttcaggtcggcgtaggtcgggtcgtgggacaggtacttcactctcaacctatcagccacgtcctagacgccgtagtaagtattttgacttagtttacttactgtactaactacgtacgtacgtacggtcggcccggtccgggactccgttccggcccgtacgggaacctaaagttgaacgtactaaccgaaacgtacgtggtcggtacgtcgaccacctacgttccgttnttccttactacttcccttccccgcctacgtccg

SEQ ID NO: 102650 - DNA, 531 bp, Homo sapiens
  misc_feature: GYAE6OF01A4GL1.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctcatctttgatgcatccatcagggccactggcatcccagccaggttcagtggcagtgggtctgggacagacttcactctcaccatcagcagccctagacgcctgaagtattttgctagtttattactgtacaactatcgtacgagtcggccgtccggggctaccgtttccggcccgtagggaacctaaagttgagatacaaacgaactgtggctcgacacatctcgtcttcactccttcccgctctcg

SEQ ID NO: 102651 - DNA, 626 bp, Homo sapiens
  misc_feature: GYAE6OF01C8YDU.8.19.B08.1.454.CMB.1.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccagggaaagagccaccctctcctgcagggccagtcagagtcgttaccacctagttacgcctggtaaccaacacaaaacctggaccaggctcccaggcccctnactcttgatgcatcatcgaggccactgcatccanccagttcagtgcagtggtctggacagactcactctcactatcagcagcctagacgctagacgtatttgactagtttacttacgtgtactaactatccgtacgacgtcggtcccgtccgggggacctaccgtttcccgggcccgttacggggtaaaccctaaacgttacgtaagtaacgttaaccgtaaaacggtaaaccgttacgggttacggtaccgttacggacccgtaaccctaacgttccgttcggtttaccctttacctaaccttacccctttcccccggtccctaacgtttaacccgg

SEQ ID NO: 102652 - DNA, 528 bp, Homo sapiens
  misc_feature: GYAE6OF01BA62P.8.19.B08.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccccctctgcagggccagtcagagtgttaccacccagttagcctggtaccaacacaaacctggccaggctcccaggcccctcatctttgatgcatccatcgaggggccactggcatcccagccaggttcagtggcagtgggctgggacagacttcactctnaccatcagcagcctggagcctgaagatgttgctagtttattactgtcaactagtcgtacgcgtggccgtccggggcctcgttccggcccgtgggaccgaaagtcggaatatacgaaacgtaactggtggctgacacctatcctgtcttcactccttcccnctnttcg

SEQ ID NO: 102653 - DNA, 568 bp, Homo sapiens
  misc_feature: GYAE6OF01DT8E2.8.19.B08.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (564)..(564): a, c, t, g, unknown or other
  misc_feature (564)..(564): n is a, c, g, or t
tcagctcgcgtgtccacgaccggtgctcgatttagtgagtcagtaaggggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggctcccaggcccctnatctttgatgcatccatcgagggccacgtggcactcccagccaggttcagtggcaggtggtctgggacagacttcactctcacatcagcagcctagacgtcctagaagtatttgacttaagtttacttacgtgtacaactatacgtacgtaggtcggccggtccggggtcctaccgtttccggcccgtagggtaacctaaagttgaacgtactacgaaaacgtacgtaggtacggacgtcgacctacctactcttgttccttactacttccttcccgctntccg

SEQ ID NO: 102654 - DNA, 746 bp, Homo sapiens
  misc_feature: GYAE6OF01C62KO.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagttgggctgagctgggttttcctcgttgcttcttttaagaggtgtccagtgtcaagtgcaactggtggagtcgtggggggggcgtggtccagccgtgggaggtccctgacgactctcctgtgcaggctcgtggacttcacccttcaagttaacctacggcgtgccacgtcgggtcccgccagggcctccgaggcaaggggcttgggagtggctggctagtttcgttcagtcgtaggaaggtagttcgttacaaattactatacgacgtacccgtcggtaagggaccggtacctacgttaccaacctacttcccaacgtaacggaacctaaaccgttaacctaaaccgaaacgtaaccgaacgttagttacgttactaccgtacgaaacgtaaagtaccggaactaaccggtaacgttaaggtaggtaacggggaaccggtaaccggttacggtttacgttttaaggttttaaccgttacgggtaaacggtttaaacgggggaaaagggggtacgggttaactaacggggtacgggtaccggtacgtaaccggtaccgttaaaccgtaacgtttacgttttcgttaaccgttacggtcggggtaccggtaaccccgggg

SEQ ID NO: 102655 - DNA, 687 bp, Homo sapiens
  misc_feature: GYAE6OF01D9Q9X.8.19.B08.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacctgtctttgtctccgaggggaanagccaccctctcctgcagggccagtcagagtgttaccaccagttacgcctggtaaccaacacaaacctggccaggctcccgacggcccctnatctttgatcgcatccatcgacgggccacgtggaccactcccgagccgtaaggttcaggtcgggctaagggtcgggtacgtggggaactagacttcacgttctcaacatcagccagcccgtaagacgtcctaggaacgttagttttacgacttaagtttaactttaacgttacggtactaaactacgttaccggttaacccggtagggtaccgggtcccggttaccccgggggaccttaacccggtttacccgggtaccccggtacgggtaaaccttaaaaagttcggaacgtaacgtaacgtaaaaacggtaacgtacggtacggtacgtacgtaaccacctaacttccgttacggttcctttaccacctttacccgttaccccgttacgtcgttacccg

SEQ ID NO: 102656 - DNA, 512 bp, Homo sapiens
  misc_feature: GYAE6OF01A9LGZ.8.19.B08.1.454.CMB.1.raw
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (418)..(418): a, c, t, g, unknown or other
  misc_feature (418)..(418): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacctgtctttgtctccaggggaangccaccctctcctgcaggaccagtcagaatgttgcgccttcgtaagctggtaccaacacaaacctggccaggctcccaggcccctcatctatggtncatccaacagggccactggcatcccagccaggttcagtgcagtggtangggacagacttcactctcacatcatcagcctggacgctgaagagtgttgactagtttatactgtacaactatcgtaccgngtcggccgtcggggcctacgttccggccgtcgggaccgtaggtcggagactacgaaacgacgtgtgcgtgcacatctgtctacatctccgctac

SEQ ID NO: 102657 - DNA, 562 bp, Homo sapiens
  misc_feature: GYAE6OF01CKS2C.8.19.B08.1.454.CMB.1.raw
  modified_base (195)..(195): a, c, t, g, unknown or other
  misc_feature (195)..(195): n is a, c, g, or t
  modified_base (445)..(445): a, c, t, g, unknown or other
  misc_feature (445)..(445): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaangccaccctctcctgcagggccagtcagagtgttacccacccagttagcctggtaccaacacaaacctggccaggctcccacggcccctcatctttgatcgcatcccatccagggccacgtggcactcccagccaggttcagtcggcaggtcggggtctaggggactaggaccttcacttctacaccatcagccagccctagacgcctagagtatttgacttagtttattactgtactaactatcgtacgngtcggccgtccgggctccgttccggtcccgtacgggacctaaagttcgagtactacgaacgacgtcgtggcgtcgactaccnttcctnttcttctacttcccttcccgctcgtaccg

SEQ ID NO: 102658 - DNA, 509 bp, Homo sapiens
  misc_feature: GYAE6OF01EFE1N.8.19.B08.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (501)..(501): a, c, t, g, unknown or other
  misc_feature (501)..(501): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagaatgttggcgccttcgtaagctggtaccaacacaaacctggccaggctcccaggccctnatctatggtgcatccaangggccactggcatcccagccagtcagtggcagtggtangggacagacttcactctcacatcatcagcctggagcctgaagatgttgactagtttattactgtacaacatcgtaccgagtcggccgtccggggcctacgttcggcccgtgggacaggtggagactacaaacgacgtcgtgctgcacatctcgtcttcnctctcccg

SEQ ID NO: 102659 - DNA, 570 bp, Homo sapiens
  misc_feature: GYAE6OF01EODWM.8.19.B08.1.454.CMB.1.raw
  modified_base (559)..(559): a, c, t, g, unknown or other
  misc_feature (559)..(559): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacccttgtctttgtctccgaggggaaagagccaccctctcctgcagggccagtcagagtgttacccacccagttagcctggtaccaacacaaacctggccaggcctacccgacggcccctcatctttgatgcatccatcgagggccacgtggacactcccgagccagggttcaggtggcaggtgggtctgggacagacttcactctacacctatcagcagcctagacgctagaagtatttgatatttattactgtacaactatacgtacgtggtcggccgtccggggctcgttaccggcccgtacgggaacctaaagttacgagtaactaccgtaaacgtacgtgtcgcgtgacacctgttctcgttaccttctacttcccgttacccncctacgttacg

SEQ ID NO: 102660 - DNA, 812 bp, Homo sapiens
  misc_feature: GYAE6OF01B2HLW.8.19.B08.1.454.CMB.1.raw
  modified_base (221)..(221): a, c, t, g, unknown or other
  misc_feature (221)..(221): n is a, c, g, or t
tcagctcgcgtgtccacgaccggtgctcgatttagtgagtcagtaagggggtaggtaacgtgcgtcaggttaggacccagagggaaccagtggaacgccccagctcacgcttcgtcttcctcctgctactctggctcccagactacccacggagagtagttgtgttgactacgtacgtctcacgtacctaaccgtgttctttgtcgtccgaaggggaaacncgcctacccttcgtccgtggccggagggtcctagtccgaggtacggttccgttaacccaacccgtagttacgcctaggtaaccaaacaccgaaaccgtcggaccacggtccctaccccgaacggtccccctatacgttccgtttacggaacttcgccttaacgtcccgtacgttaccggaaccgggtcccaacggttccgggacctaaccgttcccggaagtcccggtaaggtttccgacgggttacggaacgtaacgggttaccggggtcgtaacgggggaaactacgggttaccttacccgtaaacgttccctaacgtacccgtataccggacgtccgacgtaccgtaacgacgtcccgttaagaaccgttagtttccgaacgtttaagtttaacgttactaggttaacccaagtacgtaaccggttaacggtcggttacggccgtacccgggtaccttacggttccggaacccgtacggtaaaccgtaaagttcgaacgctaaaccgtaacgtaacgttggtacgtcgcgtacctacctagttccgtttacgtacctttcgtacctttccgtcccgtgtaactcccgg

SEQ ID NO: 102661 - DNA, 802 bp, Homo sapiens
  misc_feature: GYAE6OF01DSMWJ.8.19.B08.1.454.CMB.1.raw
  modified_base (200)..(200): a, c, t, g, unknown or other
  misc_feature (200)..(200): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctccagataccacggagagattgtgttgacacagtcctccagccacccttgttctttgtcctccgaaggggaaancgcccaccctctcctgcgagggccagtcagtagtcgttaaccacctagttacgcctacggtaaccaacaacaaaccgtggacccacgggcctcccgaccggtccccctcgtacttcgtttagactcgcctactcccagtccgaacgggccacgtcggacctacgtcccgacggtccgtaggttcgaggtcggtacgtagggttcggggtcgtaggggaacctaggtacctttaccgacctccgtaccaacctacgtaccgtaagccgtaacgtaccgtaaggccgtaccgtaaggttaacgtttagttttcggaactttaacgttttacgttacttacggtaacctaacgtacgttaccggtacgggacggttcccgggtacccgggttacccggggtacccgttaccggtttccccgggacccggtttaacggggtaaacccttaaaagggtcggtaaacgtaaccgtaaaccggtaaaacggtccgttacgggttaccggtaccgtaccggtaacccgtaaccgttaccgtttccgttaccggtttacccttaccggtttacccgttcccccgtttaccccgacgtttacgttacccggg

SEQ ID NO: 102662 - DNA, 548 bp, Homo sapiens
  misc_feature: GYAE6OF01BP85O.8.19.B08.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtgttaccacctagttacgcctggtaccaacacaaacctggccaggcctcccaggcccctnatctttgatgcatccatcgagggccacgtggccactccccagccaggttcaggtggcaggtgggtctggggacagacttcactctcaccatcagcagcctagacgcctagaagtatttgactagtttattactgtacaactagtacgtacgagtcggtccgtccggggcctacgttccggccgtagggaacctaaagttcgagactacgaacgtacgtgtgctcgacactatctcgtacttacacttaccctccgctcgtcg

SEQ ID NO: 102663 - DNA, 664 bp, Homo sapiens
  misc_feature: GYAE6OF01CNQYS.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggagtccctgagactctcctgtgcaggtctcgtggtacttcacctttcgaagtaacgtacggcgtgcctacgtgggtccgccgaggcctccgaggcctaagggtcttggagtggcgtggctagtttgttacagttcgtaggaacggtaagttgttacgaaattaccgtaataaccgtagtacctccggtagaacgggtacctagttaccaccgtatcctaccgaagactaacctaacttaccgaaagaaccgaacgtaattacgtactcgtacgtacgtaaagtacggaacacgtaccgtaaggtacgttaggacggaacgtacggtctttaagtttaattacgtaggtaaacggaaagggtaggggtaatacggacggtaggacgtaggaccttaaccgtaagttaaccttacgttgtaccgttcggtcgggtaacccgg

SEQ ID NO: 102664 - DNA, 546 bp, Homo sapiens
  misc_feature: GYAE6OF01DML44.8.19.B08.1.454.CMB.1.raw
  modified_base (293)..(293): a, c, t, g, unknown or other
  misc_feature (293)..(293): n is a, c, g, or t
tcagctcgcgtgtccacgaccggtgctcgatttagtgagtcagtaagggggggagaggagcccagcactagaagtcggcggtgtttccattcggtgatcagcactgaacacagagactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcacgtggtccncaggctccgaggcaagggcttgggagtggctggctagttgtttcatctagaaggagtgttacaatactatacagactccgtaggacgggccattcaccatctacagacgacaatacaagaacaacgatgtatctagacaataggacagacctaagagtagaggactacgtcttagtttattacgtagtaacgaaaggaggggatacgtagtggacagactaccaagtacttacttagtacttcgtcgggaccg

SEQ ID NO: 102665 - DNA, 533 bp, Homo sapiens
  misc_feature: GYAE6OF01BE3B7.8.19.B08.1.454.CMB.1.raw
  modified_base (196)..(196): a, c, t, g, unknown or other
  misc_feature (196)..(196): n is a, c, g, or t
  modified_base (423)..(423): a, c, t, g, unknown or other
  misc_feature (423)..(423): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggcctcccgacgcccctcatctttgatgcatccatcgaggccactggcactcccagcccaggttcaggtggcaggtcgggtctgggacagtaccttcacctctcaccatcacgcacgcctagacgtcctagaagtagtttgctagtttattactntcaactatcgtacgagtcggccgtccgggctacgttcggccgtaggtacaaattgagactacaacgacgtgcgtcgtcgcactctctgtctctacttcctcccnctntcg

SEQ ID NO: 102666 - DNA, 570 bp, Homo sapiens
  misc_feature: GYAE6OF01C8G36.8.19.B08.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagatttgtgttgacacagtctccagccaccctgtctttgctccaaggggaaangccaccctctcctgcagggccagtcagagtcgttaccaccagttagcctaggtaccaacacaaacctggccaggcctccaggcccctnatctttgatgcatccatcagggccacgtggcactccagccagggttccaggtcggcaggtggtctgggacagcttcgactctcacatcagcagcctagacgtcctagaagtatttgacttagtttattactgtacaactagtaccgtacgtagtccggccgtccggggtcctaccgtttccgggacccgtagggaacctaaagttgtaacgactaacgaaacgtaactggtcgactcggacactacgttcttcgttacttcacttccctttcccgcctagtaccg

SEQ ID NO: 102667 - DNA, 710 bp, Homo sapiens
  misc_feature: GYAE6OF01ASQC7.8.19.B08.1.454.CMB.1.raw
tcagctcgcgtgtccacgaccggtgctcgatttagtgagtcagtaaggggggaggagggagcccagcactagaagtcggcggtgtttccattcggtgatcagcactgaacacagaggactcaccatggagtttgggctgagctgggttttcctcgttgtctacttttaagaggtgtcagtgtcaagtgcaactggtggagtcgtggggggggctggtccgaggccgtggggagtcccgtgacggactcgtccctggtcgcgaggtctcgtggacttcaccttcaagtaactacggtcgtagccgtacgtgggtcccgccgtacggcctcccgaggccggaagggtccgttgggacggtgggcgttcgggactaggtttcggttctagtcgttaggaacggtagttaggttccaaagtactagtaacacgaccttcggaggaaacgggcccgtaattacccacctactcctacgagtacgacgtaactaccgaaagaaccagtacgtataactctagacctaagtacggtcaacgtacctaaggtagttggaacgtacgcggttaccgttatttaacgtacgtaagtaacgggtaaagggtacggggtaagtaaccgtgggtaaccgggactaacgggtacccttaaaccggtaacgtttacccgtttaaacgtttccgggaaaccgtttgggaaccggggggtaacccgg

SEQ ID NO: 102668 - DNA, 676 bp, Homo sapiens
  misc_feature: GYAE6OF01CQIX8.8.19.B08.1.454.CMB.1.raw
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
  modified_base (446)..(446): a, c, t, g, unknown or other
  misc_feature (446)..(446): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacagtctccagccacctgtcttgtctccgagggaaangccacctctctgcgacgggcctagtcagagtcgttaaccacctagttacgcctaggtaaccaacacaaaccgtggaccaggcctccgacggtccctnacttcttgactcgactatcccatcgacggtccacgtggccactcccgagtccgtagttcgaaggtcggacgtaggttcgggtaccgtagggaactaggtaccttcgactcgtacaaccgatcgacgtcaacgctaacgacgtaccgtagtaacgtntttcgtacttagtttactactagtactacgtacgtaccggtacgtacgggtacgtcccgggttaccggggtccgttaaccggttccggtacccggtagggtaaccctaaagttcgtaacgtactaacgtaaacgtacgtacggttacgtaccgtacgtaccgtaccgtacgttccgtacggtttaccgttaccttacgttaccccgttcccgtaccgttacgttacccgg

SEQ ID NO: 102669 - DNA, 562 bp, Homo sapiens
  misc_feature: GYAE6OF01ALYBL.8.19.B08.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (435)..(435): a, c, t, g, unknown or other
  misc_feature (435)..(435): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnatctttgatgcatccatcgagggccacgtggccatcccagccctaggttcaggtggcaggtgggtctgggacagacttcactctcaccatcagcagcctagacgcctagaagtatttgcttagtttacttactgtacaactatccgtacgngtcgggcccgtccggggtcctaccgtttccggcccgtacgggaacctaaagttcgaacgtacgtaccgaaacgtactggtcgcgtcgaccactgttcctgttcctactactcccttcccgctgtccg

SEQ ID NO: 102670 - DNA, 718 bp, Homo sapiens
  misc_feature: GYAE6OF01DSNZU.8.19.B08.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattcgtgttgacacagtctcagccacctgtctttgtctccgaggggaaanacgccacccgtatcctgcgagggccagtcagagtcgttaaccaccgtagttagacctaggtaaccaacaccgaaacctggaccacggtacctacccacggcccctanacttctagtcggtacactactaccgaacgacgggccaacggttggaccaacgtcccacggccgtaaggttaccaggtggacgtaggtcgggtaagtcgggaacacggtacttacgactcgtacaccatctaactacgacgtacccgtaggactaccgttaagaaagtagttggttaaccgtgttaacggttttaacacgtttacggactaaactacggttaccgtaacggtacggtcgggtacccgtacccgggggacttaccgtttcggggacccttacgggggaacccgttaaggggttacggagaacggttaccgaaaaaacccggtcgttcggacgggttaccacggtaacccgtactacgggtttaacctcgtttacgtaccaacctttccttacccgcttaacgtacgg

SEQ ID NO: 102671 - DNA, 707 bp, Homo sapiens
  misc_feature: GYAE6OF01EM4SF.8.19.B08.1.454.CMB.1.raw
  modified_base (202)..(202): a, c, t, g, unknown or other
  misc_feature (202)..(202): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagatacccaccggagagattgtgttgacacagtctccagcccacccttgttctttgtctccgagggggaaanagccaccctctcctgcgagggccagtcagagtcgttacccaccagttacgcctaggtaccaacaacaaaccgtggaccaggcctacccacggcccctcattctttgatcgctactccatccgacgggcctacgtcggacactccccaggtcctagggttcaggttggactagggttcgggtcgtaggggacaggtaccttcgactcctacaccatcagcacgacctagacgtccgtagtaagttacgttttagacgtttaagttttaacttacgttacgttactaacgtacttaccggtaccggtacggtccgggtcccggttacccgggggtacccttacccggtttacccgggtaccccggttaacggggtaaacccttaaaaggttccggaaagtaacccgttaacgaaaaccggtacgttacggtacggtaccgtacgacctaaccgtacgttaccgttacggttccttacgtactttccccttacccgtccttcgtaccg

SEQ ID NO: 102672 - DNA, 579 bp, Homo sapiens
  misc_feature: GYAE6OF01EA816.8.19.B08.1.454.CMB.1.raw
  modified_base (195)..(195): a, c, t, g, unknown or other
  misc_feature (195)..(195): n is a, c, g, or t
  modified_base (366)..(366): a, c, t, g, unknown or other
  misc_feature (366)..(366): n is a, c, g, or t
  modified_base (448)..(448): a, c, t, g, unknown or other
  misc_feature (448)..(448): n is a, c, g, or t
  modified_base (572)..(572): a, c, t, g, unknown or other
  misc_feature (572)..(572): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacctgtctttgtctccgaggggaangccaccctctcctgcagggccagtcagagtcgttaccacctagttacgcctaggtaaccaacaacaaaccgtggaccaggcctcccgacggcccctcacttctttgactcgcactcccatcgacgggccacgtggcactcccagcctaggttcaggtggctaggtgggtcnggggacagtcttcactctcacatcgagcacgcctagacgtcctagaagttattttagacttagtttacttactgtacaactntaccgtacggtagtcggtccgtccggggcctccgttccggccgtacggtaacctaagtgaacgtactaacgaacgtacgtggcggtactcgtacacctagttctgttccttcacttcccttccnctgttcg

SEQ ID NO: 102673 - DNA, 673 bp, Homo sapiens
  misc_feature: GYAE6OF01CFCMJ.8.19.B08.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgctccgaggggaaancgcccaccctctccgtgcagggccagtcagagttcgttaaccaccctagttacgcctggtaaccaacacaaaccgtggccaggcctcccgacggcccctnattctttgatcgcactccagtccgagggcccacgtcggctactcccagtccgtaggttcaggtcggcaggtcgggtcgtgggactacggtacttcactcgtacaccatcaggcacgtcctagacgtccgtagtaacgttatttcgacttaagtttacttacgttacgtactaaacgtacgtaccgtaccggtacggttccgggtcccggttacccggggacttacccgggtttccggacccggttaacgggtaaaccttaaagttcggaacgtacgtaaccgtaaacggtaccgttggtaccggtaccgtacgtacctaccgtacttccgttacgtttaccttacctacccgtttccctccccgtactacgtacccg

SEQ ID NO: 102674 - DNA, 872 bp, Homo sapiens
  misc_feature: GYAE6OF01ARC55.8.19.B08.1.454.CMB.1.raw
  modified_base (192)..(192): a, c, t, g, unknown or other
  misc_feature (192)..(192): n is a, c, g, or t
tcagctcgcgtgtccacgaccggtgctcgatttagtgagtcagtaagggggaggaactgctcagttaggacccagagggaaccatggaagcccagctcagcttctcttcctcctgctactctggctccagataccaccggagagattgtgttgacacagtctccagccacctgtcttgtctccaggggaaanagccacctctctgcagggccagtcagagtcgttaccaccagttagcctaggtaccaacacaaaacctcggccaaggcctacccgacggtcccctcaattccttttgattcgacaacttcccaagttccgaacgggggccctaacgttcgggaccaaccgttccccgaacggtccccgtaaggggtttaccaagggttacgggtaacccgtaagggtttcgggggggttaccttaacgggggggaacctaaacggggttaccctttaccaacccggttaccttaacccaaccctaacggtttaacccgaacggttacccgaaacggtaccccgtttaaggaacgggtaccccgttaacggtaaacgtttaagttttttaccggtaacgtttaaacgggtttttaacttttaaacgttaccgtttaaccggtaaacctaaccgtttaaccggggttaaccccgtagggttacccggggtacccggtccccgggggggtaaccctttaacccgggttttcccggaacccccggttacgggggtaaaccttaaaacggtttacggaacgtaaccgttaaacgtaaaaccggtaaccgttagggttaaccggcgtaccgtacaacccgtagtccttacgtttaccttactaccgtttacccttacccggtccctaacgttaccgg

SEQ ID NO: 102675 - DNA, 825 bp, Homo sapiens
  misc_feature: GYAE6OF01DEU7K.8.19.B08.1.454.CMB.1.raw
  modified_base (197)..(197): a, c, t, g, unknown or other
  misc_feature (197)..(197): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacaatctccagccaccctgtcttcgtctccgaaggggaacngcccaccctctcctgcgagggccaggtcaagtaatggttggccgtccctacggtacttcccgtaggtaacccaaagaacgtaaaacccgtcggacccaagggtccctaccccgaaccgggccccccttcacttccgtaagttcgggtcgacctaactaccccgaaacgacgggggaccctacgttcgggcctaacgtcccccaggcccgtaacggttccaggtcgggctaagggtggtagtacggggactacgacctttcaaccttcctcctaaccacttacgaactccgaacgccgttaggacgtcccgtagggaggtacgttggttacgtacgttaaggttttaacttacgtttacgtacctaaacgttaaccgttacccggttaccggttaccgggtaccggtaccccgggtttccccggggggtacccctttaacccggggttttccccgggaccccggtttaaccgggggaaacccttaaaggggtacggtaacgtttaacgtaaaaccgtaaacccggtaacggttcggtaaccgggtcgttaccggtaccccgtaacgttaccgttaccgttccgttttacttacctaacccgtttccccgttaccccgtaccgttaaccg

SEQ ID NO: 102676 - DNA, 775 bp, Homo sapiens
  misc_feature: GYAE6OF01ADQUH.8.19.B08.1.454.CMB.1.raw
  modified_base (613)..(613): a, c, t, g, unknown or other
  misc_feature (613)..(613): n is a, c, g, or t
  modified_base (721)..(721): a, c, t, g, unknown or other
  misc_feature (721)..(721): n is a, c, g, or t
tcagctcgcgtgtccacgaccggtgctcgatttagtgagtcagtaagggggaggaactgctcagttaggacccagagggaaccatggaacgcccagctcagtcttctcttcctctgctactctggctacccagtactaccgacgggagacgtatttggtcgttacgaacctacgtacgttcctaccgacggtaccctacccttggtttctttcggtccgtaccggaagggggaaacacgccctacccttcgtccgtcggacgacgggtccagtcgaacggtacgttacgttacccgacctaggttacgtccgttacgaaaccctaaaccgaaccgaaaccggtcggaccgtaaccggccccttacccgaccggtcccttagacgttctttacgacgtcgacctacctaccgacgtccggacggacctacggttccggacctaccgacccgacggtaccgttaacgggtcctaaggtccggtacggtcgggtttacggacgtacggggaaactccggttaccttaccgtaccgtccgttaccgacctacgtacgacggtccaacgtacggtacgactacgtaacgtagtttcgttcgaactttaagttaccgtntaacgtacacggtacctcgggtacgtcggtacgggtcccgacggttactccggttagacccggtagtaacctagtcgactacgtaaaccgtgtcctaggccgttaacncgtaactcctgttacccggtctttactccggtactcccggtactcgtagtaccg

SEQ ID NO: 102677 - DNA, 665 bp, Homo sapiens
  misc_feature: GYAE6OF01EPRWD.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaagagccaccctctcctgcgagggccagtcagtagtcgttaccaccagttacgcctaggtacccaacaaccaaacctggaccaggcctcccgacggcccctcactctttgatcgctactccatcgacgggccacgtggcactcccgagccaggttcaggtcgcaggtcgggtcgtgggacagtacctcgactctccacctatcgaacgcacggcccttaagacgtaccgtaggaacgtttacgttttacgacgttaagttttaacttaacgtacgtacctaaacgtacgttacccggtaaccggtagggttccgggtaccccggttacccgggggtaccttacccggtttccgggacccgtacggggtaaaccctaaagtttcggaacgtactaccgaaaacgtacgtgtaccgtcgtacgtacaccggtattccgtgttaccttacaccgttaccctcccgtctctaccg

SEQ ID NO: 102678 - DNA, 796 bp, Homo sapiens
  misc_feature: GYAE6OF01BX74L.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccacgccaccctgtctttgtctaccgaggggaaagacgccaccctctcctgcgagggccagtcagagttcgttaaccaccgtagttacgccgtcggtaaccaaacaacaaaaccgtcggaccaggccctcccgaccggcccctacacttctttgatcgacactccatcggacgggcctacgtcggcacctcccgagtccgaggttcgaggtcggacgtagggttggggtcgtacgggactaacgtaccttactaccttctaccaacctaacgtccgaacggtaccgaacgtccgttaaggacgtaccgttaaggtaaacgtttacgtttttacgtaacgtttagtttttaaacctttacgttacgttaacctaaacgttacgttacccggttaaccgggtacgggttcccgggttcccgggttaacccggggggtccctttaaccccggggtttaccgggtaccccggttaacggggtaaaccctaaaagggtttcgtaacgtaaccgttaaaccggaaaaccgtaacgttccggtagggtaccgttacgacccgtaacgttccgtttacgtttaccgtttaccctttaccttaacgtttcccccgtttaccctacccgttcgttacccggg

SEQ ID NO: 102679 - DNA, 822 bp, Homo sapiens
  misc_feature: GYAE6OF01CATID.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagtattgtgttgacacagtctccagcccacctgtctttgtctccgaaggggaaacacgcccaccctctccgtgcgagggccagtcagagtcgtaccacctagttacgcctaggtaccaacacgaaacctggaccaggcctcccgacggcccctacacttctttgattcgactactccaatcgacgggtccctacgtcggacctactcccgaacgtaccgtacggtttacgaggttcggaccgtagggttcggggtacgtacggggaacctaacgggtaccctttacctaaccgtcccgttacccgaaccctaagttacccgaaacggcctaaaccggtacccgttaacgggaccgtacccgttaaggtaaccgtttaagtttttacggtaacgtttaaacgtttttaacgtttaaaccgtttacggttaacccgtaaacgttaaccggtttaacccggttaacccgggtaacgggttcccggggttaccccgggttaccccggggggtacccttacccgggttttaccccgggacccggttaccgggggtaaccggtaacgggtacggtaacgtacgtaaccggtaaacgtaacgtcgggtacgtcgtacgtaccgaccgtcgttaccgttcgttaccttaccgtaccgttcccttaccccgtacgtacttaacccgg

SEQ ID NO: 102680 - DNA, 775 bp, Homo sapiens
  misc_feature: GYAE6OF01B8AGX.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccacgcccaccctgttctttgtctccgaaggggaaagacgcccaccctctcctgcgacgggccagtcagagtcgttaccaccagttacgcctaggtaccaacacaaaccgtggaccacggcctcccgacggcccctacacttctttgattcgactacgtccagtccgacgggcccagtcggacactcccgagccgtaggttcaggtcggacgtaggttcgggtacgtacggggaactacggtaccttcgaccgttcctaccgaaccagttaccgacgacccgtaccggtaccgtacggtaaccgtaccgttaaggtaacgtttacgttttacggtacgtttaacgttttaacgttaacgttacgttaacctaaacgttaccgttaccggtaccggtacgggttaccgggtccccgggttacccgggggtacccttaacccgggtttccccggggtacccgtaacggggtaaacccgtaaagggttacggtaacgttacgtaacccggtaaacgttaccggttacggtacggtaccgtacgtaccttaaccgttcgttccgttaccgttccttacctaccgttacccctttacccggccttaccggtaccgg

SEQ ID NO: 102681 - DNA, 665 bp, Homo sapiens
  misc_feature: GYAE6OF01B1R68.8.19.B08.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (410)..(410): a, c, t, g, unknown or other
  misc_feature (410)..(410): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcagggccagtcagacgtgttacccacctagttacgcctaggtaacccaacaccaaaccgtggaccaggcctcccgacggcccctnacttctttgatgctatccatcgacgggccacgtggaccnctcccgagcccgtaggttcaggtgcgtaggtcgggtactgggaactacggtacttaccacctcttaccaacctntacacggaccacgtaccttagacgtaccgtagaagtttacgtttgtacttaagtttacttacgttctactaactacgtaccggtacgtacggtccggtccggtccggggtccttaccgttccggaccgtacgggtaaaccttaaagttcgaacgtacgtaacgaaaccggtaactcggtacggacgtcggacctaaccgttcttacgttccgttaccctttacgtaccctttacccgtacccctcgtactaccgg

SEQ ID NO: 102682 - DNA, 849 bp, Homo sapiens
  misc_feature: GYAE6OF01ESSZR.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctgctccagactaccgacggagagtattgtgtgacactacgtctaccacgccctaccttgttctttcgtccgtaccggaaggggaaacgacgccctacccttcctccgtggcggacgggcctagtacgagtacgtccgtacccaccgtagttacgccgtacggtaccaacgaaccaacgtcgaccgcgccctacccgaccggcccctataactttcgtttacgacgtcacctacgttccgactaccggacggtaccacgtacgcctaaccgcccggtacgtaccgtacggtacgtaggtcgggagtacgggttcggcgtacgggaactccgttaccttcgaccttccactacgtacgtacgacgtcgaaccgtaccgtaacgtaccgtacgttaagtaacgttttcgtttacgttacgttaaacgttttacgtacgtttacgtaaccgttaaacggttcgttaacccggtaaccggttaccggggttcccggttaccccgggttacccgggggttaccctttaccggggttttaccccccggaaccgggtttaaacccggggtaaaacccgtttaaacggtttacggtaaacgttaaccgttaaacccggtaacggtaaccgtttcgggaacggttccggtaaccttacccgtaacggttacctttaccggtaccgtttaccgtttaccgtaccccgttttaccctaccggtaccttccggtaacccg

SEQ ID NO: 102683 - DNA, 824 bp, Homo sapiens
  misc_feature: GYAE6OF01CWLEM.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagtattgtgttgacacagtcctccgacgcccacccttgttctttgtcctaccggaaggggaaacgcgccctaccctctccgtgcgacgggaccaggtctaggtacgttacgttaacccacccgttaaggttaccgccgttacggaacccaaactaccgaaaaccgtcgggacccacggccctacccggaccggtcccctatacgttcgtttagacgttcgactacgtccaagtccgaccgggccacgtcggaccctacgtcccgaacgtccgtagggttcgacggtggcgtacgggttcgggtacggtacggaactacggttccttacctaccgtacctaacctaacgtactaccggacgtaccgaccgtacccggtaacgtaccggtaccgttaagttaaacgtttcgtttaccggaacgtttttaacgttttaactacgttaacgaaccgttaacgttaccggttaccggtaaccggtcggtacccggtcccggggttacccgggtcgtttacccgggttcccggtacccggtaaggtaaacgtaacgtaggtaacctacggtaacctaaaacgggttcgtacgggttacggtcccgaacggtaccccttaacgtaccgtttcgtttacccgttacccttactaacccgtttccccgtaccccgtattccgttacccgg

SEQ ID NO: 102684 - DNA, 956 bp, Homo sapiens
  misc_feature: GYAE6OF01EEMPZ.8.19.B08.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggcctcccagataccaccggagagattgtgttgacacagtctccagccacctgtcttgtctcgaggggaaanacgccaccctctcctgcgagggccagtcagagtcgttaccaccagttacgcctaggtaaccaacacaaaccgtggaccaggcctccgacggcccctanattctttgactgcacgtccatcgacggggcctacgtcggacctacgtcccgacgtccgtagggtttaccaagggttcgggactaacgggttcggggtaccgtacgggggaacctacggtaaccctttacgaacccggtttccttacccgaacccgtaaacgttccgaacggacccgtaacggtaaccccggttaaggtaaccggttacccgttaacgggtaaaacggtttacggttttttacgggtaacccgttttaacggtttttaaactttaaccggtttacgggtttaaccctaaaaccgtttaaccggttaacccgggtttaacccgggtaacgggtttccccgggggttaaccccgggtttacccccgggggggttacccccgtttaaccccgggttttaccccggggtacccccggtttaaccgggggtaaaaccccgttaaaacgggttttaccgggtaaacccgggtaaccgtttaaaacccgggtaaaaacccggttaaccggtttagggttaacccgggttaccggttaaacccggtaccccgttaacccggtaaaccgtttccccggtttaaccggttaccccgttttaacttaaccccggttttacccccgtttaaccccccggtaccgttaacccgggtttaaaccccgg

SEQ ID NO: 102685 - DNA, 685 bp, Homo sapiens
  misc_feature: GYAE6OF01CE3C3.8.19.B08.1.454.CMB.1.raw
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacagtctccacgccaccctgttctttgtctccgaaggggaaagcgcccaccctctcctgcgacggccagtcagagttcgtaccacctagttacgcctacgaaccaacaccaaaccgtggacccagggcctacccgaccggtccccctactactttcttagacttcgactactccactccgacgggcccagtcggcctacgtccacgtccaggttcaggtgacgtggtggtcgnggacagtacttcactctacactntacagcagcctagacgtccgtagtaagtctttcgacgtttacgttacttacgtagttactaactacgtaccggtacgacggttccgggccggttacccgggggtaccttacccggtttcccgggacccgttaacggggtaaacctaaacggttcggaaacgtacgttaaacgaaaccggttacgtcgggttaccggtcgtacggaccctaccttacgttccgttccttaccgttacccttaccgttaccccgtttcccgtctacgttaaccgg

SEQ ID NO: 102686 - DNA, 774 bp, Homo sapiens
  misc_feature: GYAE6OF01CU7BF.8.19.B08.1.454.CMB.1.raw
  modified_base (331)..(331): a, c, t, g, unknown or other
  misc_feature (331)..(331): n is a, c, g, or t
tcagctcgcgtgtccacgaccggtgctcgatttagtgagtcagtaagggggaggaactgctcagttaggacccagagggaaccatggaagcccagctcagcttctcttcctcctgctactctggctcccagataccaccggagagattgtgttgacacagtctccacgcccaccctgttctttcgtctccgaaggggaaacgtcgcccacccttctccgtcgccgacgggccagtccgaagtacgttacgttaacccacccgtaagttacgccgttacggtaacccaaacaccgaaaccgtggacccacggccctcccggacggtcccctntacttccgtttgacgttcgcacgttaccagtccggacggtccctacgtcggacctactacccgacgtcctacggttcagggcgacgtgggtacgggttcgtacggggactaacgtaccttacgtacctccgtacgtaaccgtatccgaacggactaaccggacgttacgacgtaccgtaggtaacgtttagtttcgtaacgtttaagtttacttaacgttacgttaacctaacgttaccgtaaccggtacggtaccggttccggtccccgggtaccgggtaccgttacccggttaccgggtacccggttaacggtaaccgttaaagttacgtaacgtacgtaaaccgtaaacgtaacgttcggtacgtaccgttacgaccgtaacgtcttaccgttacgttaccgttacctacctttacccgttacccgtccgtcgttaccgg

SEQ ID NO: 102687 - DNA, 684 bp, Homo sapiens
  misc_feature: GYAE6OF01A7R5C.8.19.B08.1.454.CMB.1.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgctccaggggaaangccaccctctcctgcagggccagtcagagtgttaccaccagttacgcctggtaccaacacaaacctggccaggctcccaggcccctnatctttgatgcatccatcgagggccacgtggcatcccagcccaggttcagtggcaggtgggtctgggacaggtacttcactctcaccatcagcacgcctagggacgccgtaggaggtagttggttacgtcgttaagtttacttacgtcgttactaaacgtacgttaccggtaaccggtacgggttccgggtacccgggttacccggggggtccctaaccggttttcccgggacccgttacgggggaaccctaaagggttacggaacgttaaccgtaaccgtaaaaccggtaacggttaacgggttacggtaccgttacggtaacccgtaacccgtaccgttaccggtttaccggtttacctttaccgttaacctttccccgttaccccgtaccgttaacccg

SEQ ID NO: 102688 - DNA, 797 bp, Homo sapiens
  misc_feature: GYAE6OF01BTCD9.8.19.B08.1.454.CMB.1.raw
  modified_base (195)..(195): a, c, t, g, unknown or other
  misc_feature (195)..(195): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacctgtctttgctccgaggggaaancgccacctctcctgcgagggccagtcagagtcgtaccacctagttacgcctaggtaaccaacacaaaccgtggacctacggcctcccgaacggtccccctagtaacttccgttttaggaacttcggtacctaacttccctaagttaccggaacgggggtccctaaccggttcgggaccctaaccttccccggaacggtcccgtaagggtttccgaacggttcgggaccgtaaggggttcggggtacgtacggggaacacggttacctttcgaaccttccgtaccgaaccctagtccgaacggtaccaacggttacccgtaaggtaccggtacccgttaaggtaacgttacgttttacggactttaacggttttacttaacgttagtaaccttaagtaccgttaccgtacggtacgggtacggtacccgggtccggggtacccttccggtttaccgggacccgtaacggggtaaccctaaaggtttcgaacgtacgtaaaccgaaacggttacgtacgggtacggtaccgtacgaccgtaccttaacggttccttaacgttcccgttacacccgtttacccgttaccccgtcgtccgttaccg

SEQ ID NO: 102689 - DNA, 762 bp, Homo sapiens
  misc_feature: GYAE6OF01EGQJV.8.19.B08.1.454.CMB.1.raw
  modified_base (194)..(194): a, c, t, g, unknown or other
  misc_feature (194)..(194): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctccagataccaccggagagattgtgttgacacagtctccagccacctgtctttgtctccgaggggaanacgccacctctcctgcgacgggccagtcagagttcgttaccacctagttacgcctaggtaaccaacaaccaaaccgtcggaccacggcctacccgacggtcccctctacttctttagactcgctactccacgtccgacgggcctacgtcggacctactcccgacgtaccgtaaggtttcgaggtcgggcgtagggttcggggtacgtaggggaactagtaccgttacaccgtctaccaactacgcaacgaccacgtaccgtagacgtaccgttaggtaaagtttacgttttacgtaacgtttaagtttttaacgttaacgttacggttaactaaaccgttacgttaaccgggtacggtaccgggttccgggtcccgggttacccgggggtccctttaacccgggtttcccgggtaacccggttacgggtaaaccgttaaaggttcgaaacgtaacgttaaccgaaacggtacgttacgggtacggtaccggtacgtacccgtacgttacgttccgtttcgttaccgtttccgtaaccgttttaccccgtccccgtaccttagtaccgg

SEQ ID NO: 102690 - DNA, 957 bp, Homo sapiens
  misc_feature: GYAE6OF01CWZO7.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctgctcccagataccacggagagattgtgttgacacagtctccagcccacctgttctttgtctccgaagggaaancgcccaccctctctcgcgacggcctagcagtagtacttacccacctaggttacgccgttaggtaacccaaacaccaaaacccgtggacccgacggtacctccccgaacgggtcccccttataaccgtttccgttttacgaacgttacggaccttaacgtcccgtaacgttacccggaacgggccctaacggtccggacctaccgttacccgacggtaccccgtaagggtttcccaaggggttaccggtacgtaacggggttccgggtttaccggtacggggaaacccttaggttaacccgttttaccctaaccgttcctacccgtaaacccggtactaaccgaaccggtacctaaccgggtacccgttaagggaccgtacccgtttaaaggttaacgtttacgtttttagaacgtttttaacggtttttaactaccggttaccgtaactaaaccgtacggttacccggttaacccggtacgggtacgggtacccccggggttcccggggttacccttttaacccgggtttacccggggaccccggttaaccggggtaaaacctttaaaacggttcggtaaaccgtaacgttaaaaccccgttaaaaacggggacccgtttaaacggggttccgttaaccccggttacggaacccccgtttaaaccctttcgggttacccgtttttaacgtacccccggttttttaaacccaccccggttttaccccgtttaaccccccgtaccgtttaaccggttaccggg

SEQ ID NO: 102691 - DNA, 847 bp, Homo sapiens
  misc_feature: GYAE6OF01A8BPU.8.19.B08.1.454.CMB.1.raw
  modified_base (195)..(195): a, c, t, g, unknown or other
  misc_feature (195)..(195): n is a, c, g, or t
tcagctcgcgtgtccacgaccggtgctcgatttagtgagtcagtaagggggaggaactgctcagttaggacccagagggaaccatggaagccccagcctcagcttctccttcctcctgctactctggctccagactaccacggagagtattgtgttgacacagtctcacgccacctgtcttgctcgaaggggaancgccacctctctgcgacgggccagtcaggagttcgttacccacctagttacgtccgtaggtaccaacgaccaaaccgtcggaccacgggccctacccggaaccggtcccctacactttcgttttacgacgttcgacctacgtacctagtaccggaacggggtcccctaacggtcggaccctaaccgtcccggaacgcccggttaacgggtttacaacggggtttcggggaccggttaaggggtcggggggtttaccggacggggggtaaccgtaaacggttcccgttttaccggaaaccctttcccgtaaccgtaaacctaaccgtttccgaaaccggtaccaaccgttacccggtaaggacggtaccgttaaacggttaaggttactttacggtacgtttaaagtttacttacgttacgtaacctaacgttaaccggttacgtaaccggtacggttccgggtacccggttaccggggtacccgttaacccggtttcccgggtacccgtaacggggtaaccttaaacggttcgtaacggtaacctaaccgttaaacgtacggtacggtaccgggaccgtacgtacccgaacttccgttaccttacggttaccttaccggtaccttacccgttacccgtcttcgttaacccgg

SEQ ID NO: 102692 - DNA, 773 bp, Homo sapiens
  misc_feature: GYAE6OF01CKKJK.8.19.B08.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacctgtctttgtctcgaggggaancgccaccctctcctgcacgggccagtcagtagtcgttaccacctagttacgccttaggtaccaacgacaaaccgtggacccaggcctacccgacggcccctanattctttggattcgactatccgatccgaacgggcctaacgtcggacctacgttccccgaaggtccccgtaggtttacgaggtacgggtccgtaagggttcggggttcccttaggggaacctaggtacctttaccgaccttacgtaccaaccctagtccgaacggtccgaacggtaccctaaggtaccggtaccgttaaggtaacgtttagttttacgtacgtttaaggttttaacttaccgttacgttaaccgtaaacgttacgtaccggttaaccgtacgggttcccggtacccggttacccggggtacccttaccgggtttcccgggtacccggttaaccgggtaaaccgttaaacgttacggaacgttacgtaaccgtaaacggtacgttaggtccggtacgtcgggtaacccaccggttaacgttccgttacgttaccttaccgtaccttaccttccccgtctcgttacccg

SEQ ID NO: 102693 - DNA, 731 bp, Homo sapiens
  misc_feature: GYAE6OF01C6PO8.8.19.B08.1.454.CMB.1.raw
tcagctcgcgtgtccacgaccggtgctcgatttagtgagtcagtaaggggggagaggagcccagcactagaagtcggcggtgtttccattcggtgatcagcactgaacacagagactcaccatggagttgggctgagctgggttttcctcgttgcttcttttaagaggtgtccagtgtcaagtgcaactggtggagtcgtgggggggctggtccagcctgggagtccctgagactctcctgtgcaggctctggtacttcaccttcaacgtaacgtacggcgtgcacgtcgggtccgcaggctccgaggccaagggcttggagtggctggctagtttgttacagttccgtagtaaggtaagttgttactaaatactatacaagtaccgtaccggtaggacgggtacccgtatttacacccgtaattccgtacccgaaggtacgtaaacctaacgtttacccaaaacgaaaccgtaacgtaattacggtaacttccgtaaggtaaccctaaaagttacgggaacctaacggtacccgttaaaggtaaggtttaacggaacgggtaaccgtacgggtacctttaggttttaacttacgtaaggttaaaccgggtaaaagggaacggggggttaactaacggtaacggtacgggtaccgtaacggtaccgttaacccgaaacggtttaacttaaaccggttttgtaacccgttcgggttacggggtaaccccggg

SEQ ID NO: 102694 - DNA, 666 bp, Homo sapiens
  misc_feature: GYAE6OF01BVQ6M.8.19.B08.1.454.CMB.1.raw
  modified_base (308)..(308): a, c, t, g, unknown or other
  misc_feature (308)..(308): n is a, c, g, or t
  modified_base (662)..(662): a, c, t, g, unknown or other
  misc_feature (662)..(662): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagactaccaccggagagattgtgttgacacagtcctccacgcccaccctgttctttgtcctccgaaggggaaagcgcccaccctctcctgccgagggccagtcagagtcgttaccaccctagttacgcctacggtaacccaaacaccaaacctggcccaggcctcccgacgtcccctnacttctttgactgcatccctatccgacgggcccacgtcggacctactaccccgagccgtaggttacaggtcgggactaggttgggagtcggggactagaccttcacgtcctacactactcactcacgccgtaggacgtccgtaaggactgttgttcgtacgtttaagtttacttactacgtacaaaccgtgttacccggtaaccggtgggttcccggtcccgggtacccggggtaccttacggtttcccgggacccgtacggggtacctaagggtccggaagtccgtaaccgaaccgtcggtcgacggtcgtcaccgtcacgttacgttccttcttacctacttccctacccgntacg

SEQ ID NO: 102695 - DNA, 865 bp, Homo sapiens
  misc_feature: GYAE6OF01CR8X8.8.19.B08.1.454.CMB.1.raw
tcagctcgcgtgtccacgaccggtgctcgatttagtgagtcagtaagggggaggaactgctcagttaggacccagagggaaccatggaacgccccagctcagcttctcttcctctgctactctggcctccagataccacgggagagtattgtgttgacacagtcctccacgccctaccctgttctttcgtcctaccggaagggggaaacgacgccctaccccgttctccgtgccgacgggacctagtacgaggtacgttcgttaacccaccgtagttacgccgtacggtaacccaacaccgtaaaccgtggacccgacggtccctcccggaccgtcccccttacgtactttccgtttaggacttcgacctacgtacccgtagtaccggacggccctacgtcggcctaccgtcccgacgtccggttacggttacgacgggttcggacggttagggtcgggttcgacgggaacgtacgtaaccttcctaaccgttacctaccgaacctacgtacgaaccgtacgtaccggtaccctaggaccgtcgttaaaggttaacgtttacgttttaccggttaacgttttaagtttttaaccttaacggttaccgtaacccgtaaacgttccggttaacccggtaacgggttaccgggttccccggggtaccccgggttacccggggtttacctttacccgggtaccgggtaacccggttaaccggtaaactttaacggtacgaaccgttaacctaaaccggaaacgtttcggagggttcccgtacggtaccgtaaccccgttattaccggtttacctcgttttaacccctcttaccccggtttaccccctaccgttcgttaaccggtccggg

SEQ ID NO: 102696 - DNA, 812 bp, Homo sapiens
  misc_feature: GYAE6OF01C6SZM.8.19.B08.1.454.CMB.1.raw
  modified_base (210)..(210): a, c, t, g, unknown or other
  misc_feature (210)..(210): n is a, c, g, or t
  modified_base (798)..(798): a, c, t, g, unknown or other
  misc_feature (798)..(798): n is a, c, g, or t
tcagctcgcgtgtccacgaccggtgctcgatttagtgagtcagtaagggggaggaactgctcagttaggacccagagggaaccatggaagcccagctcagcttctcttcctcctgctactctggcctcccagataccaccggagagattgtgttgacacagtcctcgagccacctgttctttgctccgaaggggaaagcgcccaccctcncctgcgacgggtccagtcagagtcgtaccaccgtagttacgccgtaggtaccaacacaaaccgtggaccaggaccctcccgacggtccccctagtacttcctttgacttcgctacgtcctaagtaccgacgggcccaacgttcgggacctacccgtacccgaacgacccgttaacggttcgaagggtccgggtacgtagggttccgggttaccggtacggggaactaacggtcccttactaacccgttccaacctacctacgttacgacggacctaacggacccttaggaaccgtaccgttaagggttaaacgtttgttttacgacgtttaacgtttttaagttaccgttcggtaacctaaccggtacgttaaccgggttaccgtaacggggttccgggtacccccgggttaccgggggttaccccttaccggggttttcccggaaccccggttaaggggtaaccctaaaggttcggtaaactacggttaaccggtaaaacggtaccgttgggacggtccttaacggacccgtaaccttcggtttcccgtagtttaccgttaccccgatttcccccggttaaccccgngttaccgttaccgg

SEQ ID NO: 102697 - DNA, 800 bp, Homo sapiens
  misc_feature: GYAE6OF01DZ6ZW.8.19.B08.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagcccaccctgttctttgtcctccgaaggggaaancgcccaccctctcctgcgacgggccagtcagtacgtacgttacccacctagtacgcctacggtaaccaacaccaaaccgtcggaccaggccctacccgacggcccctntacttcttagactcgctactccagtcgacgggcctacgtggccacgtacccacgccgtaagggttcaggtcggcgtagggtcgggtcgtacggggactaacggtacttcaccttccgtaccaacctatccgaacgccgaaccggtaccgtaaggtacccgtacccgttaggtaacgtttacgttttacgggtaacttttaacggttttaactaccgtttaacggttaacccgtaaacttaccggttaacccgggttaaccgggtacgggttccccgggtacccgggttaccccgggggtaccctttacccggggtttacccgggtaccccggtaacgggtaaacccttaaaggtttacggaaccgttacgtaaaccgtaaacggtaacgttcgggtaccggtcgttaacggacctaaccgttgttcccgtttaacgtcccttttaaccggtaccctttcccccgttaaccccgtcgtttaaccgtacccgg

SEQ ID NO: 102698 - DNA, 881 bp, Homo sapiens
  misc_feature: GYAE6OF01C96EP.8.19.B08.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaaggggaaancgcccaccctctcctgcacgggccagtccaggtacgttcgttaacccaccctagttacgcccgttacggtaacccaaacaaccaaaccgtcggcccgaacggcccttaccccgaccgggtcccccctacgtaacttcgttttagacttcgcctacttcccaagtccggaacggggtcccctaacggtcggacctaaccgtcccccgaacggccccgttaagggtttaccgaagggttcgggaccggttaggggttcggggttaccggtacgggggaacctaacggttaccctttcctaaccgttaccctaccgaacccgtataccgaacggtacccgacgtaacccgtaagggtaccgacccgttaggtaaacggtttctttttacggacccgttttaagttttaactttaccggttaccgttaaccgtaacgttacgggttacccggtaaccgggttacgggtttccccgggaccccgggttaccccgggggtacccttaccccgggttttcccgggaccccgggttacggggtaacccggtaacggggtacggtaacggtacctaaaccggaaacccgttacgggtacggtacgggtacccgtcggtaaccgtaccccgttacgttcccgttagttccccttacgttaccgttccccgttaccccgtccgtacgtacccgg

SEQ ID NO: 102699 - DNA, 923 bp, Homo sapiens
  misc_feature: GYAE6OF01DFYJ2.8.19.B08.1.454.CMB.1.raw
  modified_base (148)..(148): a, c, t, g, unknown or other
  misc_feature (148)..(148): n is a, c, g, or t
  modified_base (213)..(213): a, c, t, g, unknown or other
  misc_feature (213)..(213): n is a, c, g, or t
tcagctcgcgtgtccacgaccggtgctcgatttagtgagtcagtaagggggagaactgctcagttaggacccagagggaaccatggaagccccagctcagcttctcttcctcctgccttactcgtggctcccagataccaccggaganatttgtgttgacactagtctccacgcctacccgttgttcttttgtcctccggaaagggggaaacncgcccctacccttctccgtcggccgacgggcctagtacgagtacgttacgttacccaccgtagttaccgccgtacggtaacccaaacgaacctaacccgtcgggacccacgggtccctaccccgacggtccccctactagtttcctttagactcgacctaccttccgacgtcggaccggtcctaacggttcggacctacccgtcccgacggtacccgttaaggtttcgacgggtcggtagtaggggttccggtaggtaccggggaactacggtttacccttaccgtccgttaccacctaaccgcgttaaccacgtacccgtacggtaccctagggtaaccgttaacgttacgggttaaacgttttcttttacggtaactttttacggtttttaacttaaccgttaccggttaacaaccgttaaccggttaccggtaccggtacggggttcccgggttaccccggggtcccgggggttacccttttaaccccgggttccccggggtaacccggttaaaccggggtaaaccttttaaacgggtacggttaaaccccgtacggttaaaaccccgtaaaaacggtttccggtcgggttaacccggttccgtaaacccggtacccttaaccggttaaccggtttccgtttacgttacccccgtttacgttacccccgttccccgttaaccccggtccgttaccggtttaacccgg

SEQ ID NO: 102700 - DNA, 981 bp, Homo sapiens
  misc_feature: GYAE6OF01BEEKX.8.19.B08.1.454.CMB.1.raw
  modified_base (83)..(83): a, c, t, g, unknown or other
  misc_feature (83)..(83): n is a, c, g, or t
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
tcagctcgcgtgtccacgaccggtgctcgatttagtgagtcagtaagggggggagaggagcccagcactagaagtcggcggtntttccacttcggtgatcagcactgaacacagaggactcaccatggagtttggctgacgtcgtgggttttcctcgttgacttacgttttaagacggtcgtccagttgtacaagtgaccaagtggnggagtcggtgggggggtactggtccacgtccgtgggacggtcccnggacgtactccgtctggtcgcgacggcctcgtggtacttcctacctttaccgaacggttaaccgtcggggtacgtcggaccgtacgggttccgggtccccggtaccgaacggtccgttacccggagggtaaccgaaggggttccttacggggtacggttccggtacgtcgggttaccttaggttttcgtttacgtaactccggttaagggaaaacggttacggttcctttaaacgtaaacgtttaaactcgttaaacccgtacgtaccccgggttaccggtaaaggggaaaccccggggttacccttaaacgtttaccccaaaccctaccgttaacccctacgggtaaacgtaccggtaaaaccttaaacccgttacccgtaaaaacggaaccgttaacggtacttttaaggtaacccgtacgtaaccgaaacggttaaacgtaccggtaaccgtaaccgggtaaacctaaagggttacgggttaacgggaaccggtaaccgttaaccggggtactttttttaacggttttaaaccgttacggggtaaaacccggttaaaacggggaaaacggggggtttaacgggggaaaccccttaacgggttaacccggggtaggttaccccggtagggttaaaccccccgtaaacgtttaaccggtttaacccgttaccgggtttaaacggtttacccgggtttcccggggtaaccgggggttaaacccccgggg

SEQ ID NO: 102701 - DNA, 608 bp, Homo sapiens
  misc_feature: GYAE6OF01BPDMI.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagacgtgttaaccacccagttagccctaggtaaccaacacaaaaccttggccaggctcccaggcccctcatcctttgatgcatccatcagggccactggcatcccagccaggttcagtcggcagtggtctggggacaggacttcgactctcaccctacgtcagtcacggccttaacgagcctagtaacgtattttgactagttttatttaactcgtacaactatacgtaccgagtcggccgttccgggggccctacgtttcccgggcccgtacggggtacctaaaacgttgaaggtactacaaacgtaacgttacggtaggccgtacggaccaccgtactcgttcgttccgtttaccgactttaccttcccccgtcctacgttaccg

SEQ ID NO: 102702 - DNA, 683 bp, Homo sapiens
  misc_feature: GYAE6OF01BIIQM.8.19.B08.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaagngccaccctctcctgcagggccagtcagagtgttaccacccagttagcctggtaccaacacaaacctggccaggcctcccgacggcccctcacttctttgatcgcatccatccgacgggccacgtggaccactcccgagcctaggttcaggtggcgtacgggttggggtacgtgggacctacggtacttccacgtcctaccaacctatccgaagaccgacgaccgtagacgtacccgttaggaaacgtttagttttacgacgtttaacgttttatttaccgttacggtacctaaacgtacgttacccgtaaccggtacggtcgggtacccgggttcccgggggtacccttaaccggttttccgggaaccgttacggggtaaaccgttaaagttcggaagtacgtaacgaaacggtacgttcggtcggtcgtcgtactaccgtattccttcgttactcctaccgttcccttccccggactggtaccg

SEQ ID NO: 102703 - DNA, 716 bp, Homo sapiens
  misc_feature: GYAE6OF01EHCWV.8.19.B08.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagctcgcgtgtccacgaccggtgctcgatttagtgagtcagtaagggggaggaactgctcagttaggacccagagggaaccatggaagccccagctcagcttctccttcctcctgctactctggctcccagatacccgacggagagtattgtgttgacacagtctccagccacctgttcttgtcctccgaaggggaaancgcccaccctctcctgcgacggccagtcagtagttaccgttacccaccgtagtacgtcctaggtaacccaaacaccaaaccgtcggaccacgcctaccgaccggcccctntacttctttgactcgcacttccagtccgacgggccctacgtcggacctacccgtccacgtccgtaacggttcgacggtggtacggtacgggttcgggtacgttacgggaacgtacggtaaccttccgaccgttacctaccgtaacctacgtccgaacgtccgaaaccgttccgtaaacggccgttaaccggttaagtaacggtttacttttacggtactttaacggttttattacgtacgtaactaactacgtaccgtacgtcggtccggtcccggtaccgggtcccttacggttccggtccgtacggtaactaagtaggtacacgtaacgaacgtacgtcgtaccgtcggtacacaccttgttacctcggttaccttcgtacttacccttccgcttcgtaaccg

SEQ ID NO: 102704 - DNA, 839 bp, Homo sapiens
  misc_feature: GYAE6OF01A1YSN.8.19.B08.1.454.CMB.1.raw
  modified_base (789)..(789): a, c, t, g, unknown or other
  misc_feature (789)..(789): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctccagataccaccggagagattgtgttgacacagtctccagccaccctgtctttgtctccgagggaagacgccaccctctccgtcgcgacgggccagtcagtagtcgttaacccaccctagttacgccctaggtaacccaaacgtaaccaaaaccgtcggacccacgggccctaccccgaccggtacccccttctaaccgttccgttttacgaacgttcgtacctaacttacccgtaacttcccggaaccggggtcccctaaccggtcgggtacccaacccttcccgaaccggtacccgtaaacgggtttccgaacgggttcgggaccgttacggggttcgggggttacccggtaacgggggtaaccaacggttaaccgtttaccgacccttaccgaccccgtactaaccgtcgtaacggcccgtaacgtaccgttaacgggactaccgtaacggttaacgttacgttttaccgtacgttttaaacggttttaaccttacgttaacgttaccgaaaccgttcgttaacccggtaccggtacggttcccggggtcccggttacccgggggaccctttacgggttccccgggccgtaacgggaaccctaaaggttcgaacgtactaaaccgaacgttacgtcggtcgtcgtacgactacccgttnttacccgttgttaccttaaccgcctttaccctacccgtcgtacttaccgg

SEQ ID NO: 102705 - DNA, 762 bp, Homo sapiens
  misc_feature: GYAE6OF01EYQNH.8.19.B08.1.454.CMB.1.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
tcagctcgcgtgtccacgaccggtgctcgattttagtgagtcagtaagggggaggaactgctcagttaggacccagagggaaccatggaagccccagctcagcttctcttcctcctgctactctggctcccagataccaccggagagatttgtgttgacacagtctccagcccaccttgtcttttgtctccgaaggggaanagcccaccctctctgcagggccagtcagagtcgtaccacctagttacgcctagtaccaacaacaaacctggccaggccnccgaggcccctnattctttgatgactactccataccgacgggccagtcggctacctcccgagtccgtacgggttcaacggtggacgtagggttcggggtctacggggactacggtaccttacgaccttccacgaacctanccaaggcctacgtaccgttaagaccgtaccttaggtaacgttagttttacgtacttttaaacgttttacgtaccttacgtaacctaaacgtaccggttaccggtaacccggttacgggtaccgggttcccccgggtaaccccgggggtcccctttaacccgggtttaccccgggggtaaccccggttaaccgggggttaaacccttaaaacggtttacggtaaccgtaacccggttaaacgtaaacccggtaaaggtttcggaaccgtaccgttacgacccaacttcctaccgtttacgtactttacccgacttttacccccgtaccctacgtccgttaacg

SEQ ID NO: 102706 - DNA, 866 bp, Homo sapiens
  misc_feature: GYAE6OF01B000J.8.19.B08.1.454.CMB.1.raw
  modified_base (268)..(268): a, c, t, g, unknown or other
  misc_feature (268)..(268): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagtcgttgggtttttccctcgttgtcttacgtttttaaggagggttcgtccagtgtcaaggtgactaacgtgggtagggtacggtcgggtggggggggcgttcgggtcccgaggccgtggggcggtcccngacgtacctcgtccgtgtcgcgaggtctcgtgtacttcctaccttcgaacgtaacgtacggcgtgcgacgtcgggccgccgtcggcctaccggaggacgtaacggggtcgttagggacggtcggtcgtcgggtacgttgtttcgttacgagttcgtaagggtaaagtagttagttacgtaaattaacgtaacgtaacgacgtaacccgttccgggtaaggtaccgggtcccgtaacttacccgtaacctaagttccctaacgaacggtaaacttaacctaaaccgttaaccgaaaacggaaaccgtacggttagttactaacgttacgtaacgaacgtaaaaggttccgggaaactacggttaacggtaaacgggtggttaaaccggacggggttaaaccgttacccggggtttaaattttcgggttttaaaccgttaacggttaaaccggggtaaaacggggtaaaggggggttacgggtaaacgttaacggtacggggtacgtaaacccggtacgttacccgttaaacggttaaaccgtttacgttttaaccggttccgggttaacccggttccgggggacccggggtaaccccgg

SEQ ID NO: 102707 - DNA, 837 bp, Homo sapiens
  misc_feature: GYAE6OF01A77B3.8.19.B08.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagtattgtgttgacacagtctccagccaccctgttctttgtctaccgaggggaanacgcccaccctctcctgcgacgggccagtcagagtcgttacccaccgtagttacgcctaggtaaccaacaacaaaccgtggaccacggtcctacccgaccggtcccctagtacttcgtttagattcgctactccagtccggacggggcccacgtcggacctaccgtccccgaggtacccgtaagggttacacgggtcggacgtagggttcggggtccgtaggggaacctacggtaactttccacccgttcctaccgaaccctactaccgacggtacccgaacgttacccgtaaggtaccgtaccgttaacgggtaagttttacgtttttacggtaaccgttttaagtttttaaccgtttaaccggttacgttaacccttaaaggttaacccggtttaaccgggtaacccggttacggggttcccgggttacccccgggttaccccgggggttaccctttacccgggtttaccccggggtacccgggttaaccggtaaaaccgttaaacggttacggtaacgtaacgtaaaccgaaaacggtcggttacggtacgggtaccgtacgaccttaaccgttcgttaccgtttacggttacctttacccttaccgtttacccttccccgtacgttcgtacccg

SEQ ID NO: 102708 - DNA, 758 bp, Homo sapiens
  misc_feature: GYAE6OF01ALE0X.8.19.B08.1.454.CMB.1.raw
  modified_base (704)..(704): a, c, t, g, unknown or other
  misc_feature (704)..(704): n is a, c, g, or t
tcagctcgcgtgtccacgaccggtgctcgatttagtgagtcagtaaggggggaggaactgctcagttaggacccagagggaaccagtggaagccccagctcagcttctcttcctcctgctactctggctcccagataccaccggagagattgtgttgacacagtctccagccctaccctgttcctttgtcctccgaaggggaaatcgcccaccctctccgtgccgtacgggccctagtccgagtacggttcgttaacccacccgtagttacgccgttaggtaacccaacaaccgaaaccgttcgggaccaacggtcccttacccccgacggtcccccctgtaacgttccgttttacgacgttcgactaacctcccgtaacgtaccggacggggaccctaaccgttgggacctacctccccgtaacgaccccggtagttaccgaggtcggacggtagggtcgggtccgttacgggacacggttacttccgaccgttactacccactacgtacaacggtccaccgtaccgaagtaccggtaactggtaagttcttttacgccgtttaagtttacgttacctggtacctacgtaccgttacgccggtagggtcccgggtcccggtacccggggtacttaccgttcccgggtacccgtacgggtaaacctaaggttcaacgtacaaacgtaccgagtcgacggtaccncgtacgactcggttccttcggttacctaccgtacttccgtacccgctagtaccg

SEQ ID NO: 102709 - DNA, 752 bp, Homo sapiens
  misc_feature: GYAE6OF01BSYBF.8.19.B08.1.454.CMB.1.raw
  modified_base (203)..(203): a, c, t, g, unknown or other
  misc_feature (203)..(203): n is a, c, g, or t
tcagctcgcgtgtccacgaccggtgctcgatttagtgagtcagtaagggggaggaactgctcagttaggacccagagggaaccatggaacgccccagctcagcttctcttcctcctgctactctggctcccagataccaccggagagattgtgttgacacagtcctccagcctacccctgttctttgtcctaccgaggggaanacgcccacccttctcctgcacgggccagtcagtagtacgttaccaccctagttacgcctaggtaccaacacaaaccgtcgaccacggcctcccgacggcccctacacttctttagatcgctactaccatccggacgggccctacgtcggcctacgtcccgagcccgtaggttccgaggttcggtactagggttcggggtacggtacggggtacctacggtacctttcccgtaaccttcctaccgaccttactaccgtaacgccgaccggtacccgtaaggaccgttacccgttaaggtaacggtttacgttttcggttacgtttaaacgtttttacttaaccgttacgttaaccctaaactccggttacccgggtaccggtaggttccccgggtacccggttacccgggggtccttacccgggtttcccgggaccggtaccgggtaaacctaagttcgaagtaccttaacgaacgtacgtcgtacgtaccgtacacctacctcgttccttacgttcccttactcttaccccgtcccaccgttcgtaccg

SEQ ID NO: 102710 - DNA, 577 bp, Homo sapiens
  misc_feature: GYAE6OF01AJ9WR.8.19.B08.1.454.CMB.1.raw
  modified_base (106)..(106): a, c, t, g, unknown or other
  misc_feature (106)..(106): n is a, c, g, or t
  modified_base (197)..(197): a, c, t, g, unknown or other
  misc_feature (197)..(197): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (571)..(571): a, c, t, g, unknown or other
  misc_feature (571)..(571): n is a, c, g, or t
tcagctcgcgtgtccacgaccggtgctcgatttagtgagtcagtaagggggaggaactgctcagttaggacccagagggaaccatggaagccccagctcagcttcncttcctcctgctactctggctcccagataccaccggagagattgtgttgacacagtctccagccaccctgtctttgtctccaggggaaagngccaccctctcctgcagggccagtcagagtgttaccacccagttacgcctggtaccaacacaaacctggccaggctcccaggcccctcatcttgatgcatccatcgaggccactggcatcccagccaggttcagtgcaggtggtctgggacagacttcgactcctcaccntcacgcacgcctagcgtcctagtaacgtnttttgacttagttttaactacgttgtacaacgtactcgtacgtacgtcggcccgtaccggggccttaccgttccggcccgtagggtaaccctaaagttcgaacgtactacgaaacgtactggtcgacgtcgaccactatccgttcgtaccttcgtaccttcccgttcccgacctnttaccg

SEQ ID NO: 102711 - DNA, 765 bp, Homo sapiens
  misc_feature: GYAE6OF01CMFSP.8.19.B08.1.454.CMB.1.raw
  modified_base (755)..(755): a, c, t, g, unknown or other
  misc_feature (755)..(755): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagatacccaccggagagtattgtgttgacacagtctccacgcccaccctgttcctttgtctccgaggggaaacgcgaccctaccctctcctaggccgacggggcctacgtcgaaggtacgttacgttaaccccaccctaagtttacgcccgttaggtaacccaaaccaaccgtaaaccgtcggacccaacggtcccttccccgaccggtcccccttactactttctttgacttcgacctacgtccacgttaccggacgggtacccaacggtcggacctacccgtacccgtacggtccgtaacggttcacggtcgggcgtaggttcgggtcgtacgggactacgtaccgtctactccgtaccaccgtactacgacgcgtacgtaccgtagccgtacgtagtacttagtttcgagttttaagttacttacgtacttaacaacgtaccgttaccggtacggttaggtcccggggttaccccggtcccggggtaccgttacccggttccgggaccccggtaaagggtaaccttaaacggttcgaaacgtaccgtaaacgtaaccggtaacgtcggtacggtcctccgtaccacgtacgttcgtacgttctacctcgttccctacccgtntacccgtacg

SEQ ID NO: 102712 - DNA, 523 bp, Homo sapiens
  misc_feature: GYAE6OF02GRXI6.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccagcccctcatcttgatgcatccatcagggccactggcatcccagccaggttcagtggcagtggtctgggacagacttcactctcaccatcagcagcctagagcctgaagtattttgctagtttattactgtctaactatcgtacgagtcggccgtccggggcctaccgtttccggcccgtgggacctaaagttcgagatacaacgtactgtggcgtgcaccatctgtcttcattccttccgcctatcc

SEQ ID NO: 102713 - DNA, 548 bp, Homo sapiens
  misc_feature: GYAE6OF02HQOHD.8.19.B08.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttacgcctggtaccaacacaaacctggccaggctccaggcccctnatcttgatgcatccatcagggccatggcatcccagccaggttcagtggcagtggtctgggacagtacttcactctcaccatcagcagcctagacgcctgaagtatttgctagtttatactgtacaactactacgtacgtagtcggccgtccggggtctaccgtttcggcccgtacgggacctaaacgttcgaagtactaccgaaacgtacgtgtacggtacgtgacctacgtactcgtagttacttcacttcctcccgtctatcg

SEQ ID NO: 102714 - DNA, 539 bp, Homo sapiens
  misc_feature: GYAE6OF02H62MN.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccaggttcagtggcaggtgggtctggggacagacttcactctcacatcagcagcctagacgcctagaagtattttgctagtttattactgtacaactatcgtacgagtcggccgtccggggcctacgtttccggcccgtgggaacctaaattcgaagatacaaacgtactgtcggctcgaccaccatcttgtcttctacttccttccccgcctatccg

SEQ ID NO: 102715 - DNA, 536 bp, Homo sapiens
  misc_feature: GYAE6OF02F9CGD.8.19.B08.1.454.CMB.1.raw
  modified_base (198)..(198): a, c, t, g, unknown or other
  misc_feature (198)..(198): n is a, c, g, or t
  modified_base (434)..(434): a, c, t, g, unknown or other
  misc_feature (434)..(434): n is a, c, g, or t
  modified_base (529)..(529): a, c, t, g, unknown or other
  misc_feature (529)..(529): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagatacccaccggagagattgtgttgacacagtctccagcccaccctgtctttgtctccaggggaaangccaccctctcctgcagggccagtcagagtgttacccacccagttagcctggtacccaacacaaacctggccaggcctcccaggcccctcatctttgatgcatccatcagggccacgtggcactcccagccaggttcagtggcaggtgggtctggggacagacttcactctcacatcagcagccctagacgcctagaagtattttgctagttttattactgtacaacatcgtacgngtcgccgtccggggcctacgttccggcccgtgggaacctaaagttgagactacgaaacgactgtgcgtgacaccatctgtcttctatccgtcccncctatcg

SEQ ID NO: 102716 - DNA, 525 bp, Homo sapiens
  misc_feature: GYAE6OF02FHE7Q.8.19.B08.1.454.CMB.1.raw
  modified_base (502)..(502): a, c, t, g, unknown or other
  misc_feature (502)..(502): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtccagagtgttaccacccagttagcctggtaccaacacaaacctggccaggctcccaggcccctcatctttgatgcatccatcaggccactggcatcccagccaggttcagtggcaggtgggtctggggacagacttcactctcaccatcagcagcctagacgcctgaagattttgcagtttattactgtcaacatccgtaccgagtcggccgtccgggggcctacgtttccggcccgtacgggaccaaagttcgaacgatcaaacgactgtcgctgcaccntctgtcttcattctcccgccatc

SEQ ID NO: 102717 - DNA, 537 bp, Homo sapiens
  misc_feature: GYAE6OF02FHOPN.8.19.B08.1.454.CMB.1.raw
tcagctcgcgtgtccacgaccggtgctcgatttagtgagtcagtaaggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtcccctgagactctcctgtgcaggctctggattcaccttcagtaactacggcgtgcactgggtccgccaggctccaggcaagggcttggagtggctggcagttgtttcatctgaaggaagtgttcaatggtatgctgacgccgtgaagggccattcaccatctcagagacaactccaggaacacaatgtattggactgaacagcctaagtcctgaggacacgggtgtatactactgtacgaaggaggggaccaggcgggagttccgaagtactccgttgacgtcgtcgggccacgggtaccctggtaccg

SEQ ID NO: 102718 - DNA, 585 bp, Homo sapiens
  misc_feature: GYAE6OF02IFAHA.8.19.B08.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (405)..(405): a, c, t, g, unknown or other
  misc_feature (405)..(405): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttacgcctggtaccaacacaaacctggccaggctcccaggcccctnatcttgatgcactcatcgagggccacgtggcactcccagcctaggttcaggtggcgtaggtgggtctggggacaggtacttcacttcaccaccatcagcagccctagacgccgtagaagttntttagcttagtttacttactgtacaactactaccgtaccgaggtcggccgtccggggcctaccgttccggcccgtagggaacctaaagttcgagtaactacgaaacgtactaggtcggtactgacctaaccgtacttccgtacgttccttactaccttcccgtacccgtacctattaccg

SEQ ID NO: 102719 - DNA, 540 bp, Homo sapiens
  misc_feature: GYAE6OF02F4OSZ.8.19.B08.1.454.CMB.1.raw
  modified_base (284)..(284): a, c, t, g, unknown or other
  misc_feature (284)..(284): n is a, c, g, or t
  modified_base (425)..(425): a, c, t, g, unknown or other
  misc_feature (425)..(425): n is a, c, g, or t
  modified_base (494)..(494): a, c, t, g, unknown or other
  misc_feature (494)..(494): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatcttgatgcatccatcagggccatggcatcccagccaggttcagtggcaggtgggtctgggacagacttcactctcaccatcagcagcctagagcctgaagtattttgcttagtttattactgtacaactactcgtacgngtcggccgtccggggcctacgttccggcccgtgggaacctaaagttcgagtactacgaaacgtacgtgnggactgacctacctagttctgttcttctacttcctcccgactatcg

SEQ ID NO: 102720 - DNA, 539 bp, Homo sapiens
  misc_feature: GYAE6OF02GM1GZ.8.19.B08.1.454.CMB.1.raw
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatcttgatgcatccatcgaggccactggcactcccagccaggttcagtggcagtggtcngggacagacttcactctcacatcagcacgctagacgcctagaagtatttgctagtttattactgtacaactatacgtacgagtcggccgtccggggcctacgtttccggcccgtcgggtaacctaaagttgaagactacaaacgtaactggtacgcgtcgacctacattctgtcttctacttcctcccgcctatcg

SEQ ID NO: 102721 - DNA, 601 bp, Homo sapiens
  misc_feature: GYAE6OF02JO869.8.19.B08.1.454.CMB.1.raw
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctnatctttgatgcatccatcagggccactggcactcccgagccaggttcagtgcagtggtcngggacagacttcactctcacatcagcagcctagacgcctgaatagttttagcttaagtttattactgtactaacgtacttaccgtaccgtagtcggtcccgtcccggggaccttaccgtttccggaccccggttacgggtaaccctaaaagttcgaacggtaacgtaaccgtaaacgtaaccgttggtacggtaccgtacggaccaccgtactcgttagtcctttacaccttcccgttcccgtaccgtactaccgg

SEQ ID NO: 102722 - DNA, 557 bp, Homo sapiens
  misc_feature: GYAE6OF02GAXDZ.8.19.B08.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (351)..(351): a, c, t, g, unknown or other
  misc_feature (351)..(351): n is a, c, g, or t
  modified_base (412)..(412): a, c, t, g, unknown or other
  misc_feature (412)..(412): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctntcctgcagggccagtcagagtgttaccacccagttagcctggtaccaacacaaacctggccaggctccaggcccctnatctttgatgcatccatcaggccactggcatcccagccaggttcagtggcagtggtctgggacagcttnactctcacatcagcagcctagacgcctgaagtattttgctagtttacttactgtacaactntacgtacgagtcgccgtccggggctacgtttccggcccttagggaaccctaaagtttgaacgtacgtacgaaaccgtaacgtgtacggtacgtcggacctaccaacttcgtagttccttctacttccctttcccgcctacttccg

SEQ ID NO: 102723 - DNA, 663 bp, Homo sapiens
  misc_feature: GYAE6OF02JNDGG.8.19.B08.1.454.CMB.1.raw
  modified_base (310)..(310): a, c, t, g, unknown or other
  misc_feature (310)..(310): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
tcagctcgcgtgtccacgaccggtgctcgatttagtgagtcagtaaggggggaggagggagcccagcactagaagtcggcggtgtttcctattcggtgatcagcactgaacacagaggactcaccatggagttgggctgagctgggttttcctcgttgctcttttaagaggtgtccagtgtcaagtgcaacgtggtggagtcgtggggggggctgggtccgaggccctgggggagtcccgtggagacctctcctgtgccgaggctcgtggattccaccttcacgtaactacggcgtgcacgtgggtcccnccgaggcctccgaggcaaggggccttgggagtggccgtgggcctagggtttcgtttacagttccgtagggtaaaggtaagttcggtttaccaaagttactaatacgtaacgtaccgttcgggtagtaaacgggggcctacgtaccaccctatcctaccagacgaactaacgtaccaaagaacgaacgtactagtaagtcacgtanaaacgtgaacncgaacgtaagagtgaacggacgacgtacttagtttacgttagtaaggtaacgaaagggtcggggaactacggaacggttggacaggtacgtaccgaaggtttaccttaccgttaggtaccgttggtaccggggcccg

SEQ ID NO: 102724 - DNA, 538 bp, Homo sapiens
  misc_feature: GYAE6OF02HF4F0.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtcccgccaggctccaggcaagggcttggagtggctggcagttgtttcatctgaaggagtgttcaatactatacagactccgtgaagggccattcacatctccagagacaacttccaagaacacgatagtatctgacaatggacagacctaagagttagaggacacggcttgtttattactagtacgaaggaggggatacgaggtggacgagctacgaagtacttacgtttagacgttcgtgggtaccg

SEQ ID NO: 102725 - DNA, 517 bp, Homo sapiens
  misc_feature: GYAE6OF02GG7LU.8.19.B08.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccacctctcctgcagggccagtcagaatgttggcgcctacgtatcctggtaccaacagaaacctggccaggcctcccaggcccctnatctatggtncatccaacagggccactggcactcccagccaggttcagtggcagtgggtatgggacagacttcactctcaccatcatcagcctggacgcctgaggtatgttgactagtttattactgtctaacatacgtacgagtcgccgtccggggcctacgttccgccgtcggaccaagtgatactacaacgacgtgtgctgcacntctntctctactcctcccg

SEQ ID NO: 102726 - DNA, 559 bp, Homo sapiens
  misc_feature: GYAE6OF02HHK1P.8.19.B08.1.454.CMB.1.raw
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
  modified_base (556)..(556): a, c, t, g, unknown or other
  misc_feature (556)..(556): n is a, c, g, or t
tcagctcgcgtgtccacgaccggtgctcgatttagtgagtcagtaaggggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccacggcccctcatctttgatgcatcatcagggccacgtggcactcccagccaggttcaggtggcaggtgggtctggggacngacttcacttctcaccatcagcagcctagacgcctgaagtatttgactagttttattactgtacaactatcgtaccgnggtcgtccggtccggggcctacgtttccggcccgtagggaacctaaagttcgaagtactaacgaaacgtacgtagtcggtcgtacgccaccgattctgttcttctaccttccgttcctctntcg

SEQ ID NO: 102727 - DNA, 526 bp, Homo sapiens
  misc_feature: GYAE6OF02G8T1H.8.19.B08.1.454.CMB.1.raw
  modified_base (197)..(197): a, c, t, g, unknown or other
  misc_feature (197)..(197): n is a, c, g, or t
  modified_base (390)..(390): a, c, t, g, unknown or other
  misc_feature (390)..(390): n is a, c, g, or t
  modified_base (519)..(519): a, c, t, g, unknown or other
  misc_feature (519)..(519): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccacccagttagcctggtaccaacacaaacctggccaggctcccaggcccctcatctttgatgcatccatcagggccactggcactcccagccaggttcagtggcagtgggtctgggacagacttcactctcaccatcagcagcctagagcctgaagtnttttgctagtttattactgtcaactatcgtacgagtcggccgtccggggcctacgttccggccgtcgggacctaaagttcgagactacgaaacgactgtcgcgtgaccacatcttgtcttcatcctccncctatcg

SEQ ID NO: 102728 - DNA, 643 bp, Homo sapiens
  misc_feature: GYAE6OF02GEFY0.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtcgttaccacccagttagcctggtaccaacacaaacctggccaggcctcccaggcccctcatctttgatgcatccatcgacgggccacgtggcactcccagcctaggttcaggtggctaggtgggtctggggtactttcggttcacttctacacctataccaaacttaaccctgacctaaattctagtaccgtactttgactttagttttactttctgttacagtcgtagttcgtaggtaacgtcgttcgggtccgtttacctaccgtttacgggacgggtaacgggtaccgtaagggttacggtaaccgtaaccgtaaacggtaacgttcgggtacggtctacgaccgtaaccctattccgtacgtttccttacgttaccttcccgttaccccgtcctacgttccgtaggtaaccg

SEQ ID NO: 102729 - DNA, 565 bp, Homo sapiens
  misc_feature: GYAE6OF02GIB9H.8.19.B08.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccggataccaccggagagattgtgttgacacagtctccagccaccctgtctttgtctccaggggaaanagccaccctctcctgcagggccagtcagagtgttaccacccagttagcctggtaccaanaccaaacctggccaggctcccaggcccctnatctttgatgcatccatcagggccactggcatcccagccaggttcagtggcaggtgggtctgggacagacttcgactctcaccatcagcagcctagcgcctagaagtattttgctagtttattactgtacactattacgtacgagtcggccgtccggggcctaccgtttccggcccgtcgggtaacctaaacgttcgaagtaactacgaaaccgtacgtacgtacgcgtagtaccacctagtactgtacttactacttccttacccgtcctactctacgg

SEQ ID NO: 102730 - DNA, 533 bp, Homo sapiens
  misc_feature: GYAE6OF02G9IOP.8.19.B08.1.454.CMB.1.raw
  modified_base (425)..(425): a, c, t, g, unknown or other
  misc_feature (425)..(425): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagacgcctgaagtattttgctagtttattactgtacaacatcgtaccgngtcggccgtccggggcctacgttccggcccgtacgggaacctaaagttcgagtactacgaaacgactgtcggctgccacatctgttcttcacttcctcccgctactcg

SEQ ID NO: 102731 - DNA, 575 bp, Homo sapiens
  misc_feature: GYAE6OF02HO6ZT.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttacgcctggtaccaacacaaacctggaccaggctcccaggcccctcatcttgatgcatccatcgagggccacgtggcatccccagcccaggttcaggtcggcaggtggggtctggggacaggcttcactcacacatcagcagcctagacgcctagaagtatttgacttagtttattactgtactaactagtaccgtaccgtagtcggtccgtccggggtcctaccgtttccggcccgtacgggaacctaaagttcgaacgtactaacgaaacgtaacgtcgtaggacgtcgaccaccgtattcgtgttcttctacttccgtcccgtacctactacg

SEQ ID NO: 102732 - DNA, 606 bp, Homo sapiens
  misc_feature: GYAE6OF02GZ00R.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccacgtggcactcccagccaggttcagtggcaggtggtctgggacagtacttcactctcaccatcagcagcctagagcctagaagtatttgcttagtttacttacttgtactaactagttaccgtaaccgtaggtcggtcccggtccgggggacccttaccggtttcccgggcccgttacgggaacctaaagttcgaacggtactaacgaaaccgtaacgttacggtacggtcgtcgtaccaccgtacgttccttagttacctttactaccttcccgtttaccccggacctacgttaccg

SEQ ID NO: 102733 - DNA, 575 bp, Homo sapiens
  misc_feature: GYAE6OF02FOHQC.8.19.B08.1.454.CMB.1.raw
  modified_base (406)..(406): a, c, t, g, unknown or other
  misc_feature (406)..(406): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccacggcccctcattctttgatgcatccatcgagggccactggcactcccagcctaggttcagtcggcaggtgggtctggggacaggtacttcgacctctacacctatcagcacgcctagacgctagaagtntttgactagtttattactagtactaactataccgtaccgtagtcggtcccgtccggggtcctaccgttccgggcccgtacgggaacctaaagttcgaagtactacaaacgtacgtgtcggtacgtcgcctacctatccttgtccttctacttccttcccgtcctatccg

SEQ ID NO: 102734 - DNA, 751 bp, Homo sapiens
  misc_feature: GYAE6OF02JUEK1.8.19.B08.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagctcgcgtgtccacgaccggtgctcgatttagtgagtcagtaaggggaggaacgtgctcagttaggacccagagggaaccatggaagcccagctcagcttctcttcctcctgctactctggctcccagtttcagataccaccggagagattgtgttgacacaatctccagccaccctgtccttcgtctccgaggggtaaacagcccaccctctcctgcaggccagtcagactgttcgcncctacgtntcctggtaccaacgagaaacctggacccaggcctaccccacggccccctgactcctaatcggtcgacactcccaaccggagggcccaccgtggaccactccccgagtcccagggttccaggtcggctaggtcggggtatcggggacctaggtaccctttcgacctactcccgaaaccgtcttccaaatttcccgaacgtccgtacgggtacgtaccggtacggtaaccggtagttacggttacggtaccgttaacgtttaccgtttacgttacgttaaccgtaaccgttaaccgtaccggttaaccggtaccgggttaccgggtacccgggttaccccgggggtacccgttacccgggtttcccgggtaccccggttaccgggtaaccggtaaccggtaacgggtacgtacgtaccgtaacgtaaccgtacgggttacggtaccgtcgtaccgtaccgaccgttccgttacgttaccgtttccgtacttcccgttacccgg

SEQ ID NO: 102735 - DNA, 528 bp, Homo sapiens
  misc_feature: GYAE6OF02FJ5DI.8.19.B08.1.454.CMB.1.raw
  modified_base (349)..(349): a, c, t, g, unknown or other
  misc_feature (349)..(349): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctcatctttgatgcatccatcaggccactggcatcccagccaggttcagtggcagtggtctgggacngacttcactctcaccatcagcagcctagacgcctgaagtattttgctagtttattactgtacaactatacgtaccgagtcgccgtccggggcctacgtttccggcccgtcgggaacctaaagttcgaagtactacaaacgactgtcgctgccaccatctgtcttcactcctcccgcatc

SEQ ID NO: 102736 - DNA, 646 bp, Homo sapiens
  misc_feature: GYAE6OF02JNIDI.8.19.B08.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (343)..(343): a, c, t, g, unknown or other
  misc_feature (343)..(343): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgctccaggggaaangccaccctctcctgcagggccagtcagagtgttaccaccagttagcctggtaccaacacaaacctggccaggcctcccgaggcccctnactcttgatgcatccatcaggccatggcatcccagccaggttcaggtcggacagtggtcngggacagaccttcactctcgacctattccaagtcgagcctaagacgtcctagaaacgtattttcgacttagtttacttaactcgtaccaaacgtacttaccgtaaccgtaggttccggtcccggttaccgggggtaccttaccggtttaccgggacccgtacgggtaaacccaaaacgtttcggaaacgtaccgtaaccgtaaaccgtacgttaggttacggacgtaccggtacgtaacccgtaacgttacgtaccgtttaccgttacgtacctttacccgttaccccgtaccgtaccttacg

SEQ ID NO: 102737 - DNA, 622 bp, Homo sapiens
  misc_feature: GYAE6OF02FLTIH.8.19.B08.1.454.CMB.1.raw
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (555)..(555): a, c, t, g, unknown or other
  misc_feature (555)..(555): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgtggccagtcagagcgttaggacgaacttagcctggtatcagcagagcctggccaggctcccagactcctnatcttggcncctttacagggccagtggaatcccgacncgtacgtcgacggcgacgtggtcggtcggtacggtcttcgtactaccttcaccactactactaaactacgtcgaactacttcgacgtacgttacgtttcgacgtttagttttactttgttactacgactacgttagttacgtacgtaacgtcggtaccggttccttaccgttcggtttaccgggacgggtaccggtacgtaacgggtaccgtacctaacgaaaccgtagtacggngtccgtacgaccaactacttcgttcgttcctactccttcccgtcccgactcgttacgacgtaaccgg

SEQ ID NO: 102738 - DNA, 532 bp, Homo sapiens
  misc_feature: GYAE6OF02IIDD0.8.19.B08.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnactcttgatgcatccatcagggccactggcatcccagccaggttcagtggcagtggtctgggacagacttcactctcaccatcagcacgcctagacgcctagaagtattttgcttagtttacttactgtacaactatcgtacgtagtcggccgtccggggcctacgttccggcccgtgggacctaaagtcgagactacaacgtactagtcggctgaccactatctgtcttcacttcctcccgctatcg

SEQ ID NO: 102739 - DNA, 545 bp, Homo sapiens
  misc_feature: GYAE6OF02GUD72.8.19.B08.1.454.CMB.1.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
  modified_base (505)..(505): a, c, t, g, unknown or other
  misc_feature (505)..(505): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtacccaanaccaaacctggccaggcctcccaggcccctcatctttcggcgtcctttaacagggccaggtggaactcccagccaggttcagcgcagtgggtctgggacttcgtcactcncacatcaatactgacaatctgacgtactttgctagtttatttctgttctagtcagttctagaacgtactggtccgtttctacgtttcgggcggtaggaccgaagggtcgacctacgaaacgtactgtcgtctgacactntctgtctcactctcccgctatcgtgacgacacgcgagtcg

SEQ ID NO: 102740 - DNA, 733 bp, Homo sapiens
  misc_feature: GYAE6OF02IFYHG.8.19.B08.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
tcagctcgcgtgtccacgaccggtgctcgatttagtgagtcagtaagggggagggaacgtgctcagttaggaccagagggaaccatggaagcccagctcagcttctcttcctcctgctactctgctccagataccaccggagagattgtgttgacacagtctccagccacctgtctttgtctccgaggggaaanacgccaccctctcctgcgagggccagtcagngtcgttaccacctagttacgccttggaaccaanaccaaacctggcccaggcctcccgacggccctcacttctttgactgcacttccattccgacggcccagtcgacctacgtccccagaccgtaggttccaaggtcggaccgtaaggttgggggtcctagggggtacaaggtaacctttcctacggttcctaccgaacctagtaccgaacgtccgaacggtcccgtaagacggtccctaaggtaacggtttactttacggtacttaacggttttaactttaaccgttcggttaactaaaccgttaacgtttaccggtaaccggtaacggttcggtacccggtccggggttaccgttaccggttccgggtacccgtaccgggtaaacgtaaacgttcggtaacgtaacgttaacgtaaaccgtaacgtacggtacggtcgtaaccggacctacctaacgttaccgttcgtaccttaccgttaccttcccgtttacccgtctaacttcgg

SEQ ID NO: 102741 - DNA, 571 bp, Homo sapiens
  misc_feature: GYAE6OF02IYXG2.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggcctcccaggcccctcatctttgatgcatccatcaggccacgtggccatcccagccaggttcagtggcaggtcggctgggactaggacttcgactctcactatcagcacgcctagagcctagaagtatttgcttagttacttactagtactaactatcgtaccgtagtcggtccgtccggggcctacgtttccggcccgtacggtaaccgtaaacgttacgtacgtactaacgaaacgtaacgtgttacggacgtcgaccacctagtccgtgtccttctacttccgttcccgtcctacgtccg

SEQ ID NO: 102742 - DNA, 553 bp, Homo sapiens
  misc_feature: GYAE6OF02F72TT.8.19.B08.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccacccagttagcctggtaccaacacaaacctgccaggctcccagcccctnatcttgatgcatccatcgagggccacgtgcactcccgagccaaggttcagtggcaggtggtctagggacagcttcactctcacntcagcacgctagacgcctagtaagtattttgacttaagtttacttactntactaactactacgtaccgtagtcggccgtccggggcctaccgttccggtcccgtacgggaccaaggtcgaatacgtacgaaacgacgtgtcggacgtgaccacactcgtgtcttactacttcctcccgtaccattcg

SEQ ID NO: 102743 - DNA, 1200 bp, Homo sapiens
  misc_feature: GYAE6OF02GATY5.8.19.B08.1.454.CMB.1.raw
tcagctcgcgtgtccacgaccggtgctcgatttagtgagtcagtaagggggaggaacgtgctcagttaggacccagagggaaccatggaagccccagctcagcttctcttcctcctgctactctggctcccagataccaccggagagattggtgttggaccaaagtctccacgccaccctacgtctttcgttcgtccacggggaaaggagccgaccctcctcctgcagggccgagtcacgagtcgttacctacccacgttaagccgtacggtaaccgaaaccaactaaaacccgtacgggtccgaacgggacttacccccaacgggtacccccttaccgtaactttccttttcgggtaactacggtaccctaacttacccgtaaccttcggaaccgggggaccccgtaaccccgtacgggggtaccctaacctttaacccccgttaacggaccccgtaacgggggtttttacccgttaacggggtcggggtccccgtaacggggtttacgggggggtttcccgtttaacggggggtaaccctaacgggtttaaccctttttccccggaaacccttttccccggtttaaccgtaaaccccccgtaaaggtttacccctaaaccgggtaccccggtaaacgtaccccccgttttaaaggggaaacccgtacccccgtttaacgggtttaaaacgggttaaaaccgttttttttacgggtacccgggttaaaaccggtttttttaaacgtttttaaaacccgtttaccggggttaacccttaaaaacccggttaaacgggttttaaacccccgggttttaaacccccggggttaaacggggtttttaaccggggggtaccccccgggtttcccccgggggggggggtaacccccgttttaaacccccgggtttttttcccccgggggttaaacccccccggggtttaaccggggggtttaaaaaacccccggggtaaaaaaaaccggtttttttcgggggaaaacccggtttaaaacggtttaaaacccccgggtttaaaaaaaacccggtaaccgggttttacccggggttttaaggggggccccgttttaaacccggggtaaaccccggttaaaacccccggtaacggttttaaacccgtttcccgggtttttaaccgttaccccgtttaacggttttacccccggtttacccccccggtt

SEQ ID NO: 102744 - DNA, 577 bp, Homo sapiens
  misc_feature: GYAE6OF02GXVSJ.8.19.B08.1.454.CMB.1.raw
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgccacgtgggtcccgccaggcctcccgagggcaagggcttgggagtggctgggctaggttcgtttcatcgtaggaaggtaagttgttacaaattactatacgagacctccggtagaacggggtccattcacctatcncaganaactaataccaagaacacgatacgtatctagactaaatggacagacctaagagttacgaggacgacggtcttgtttactactagtacgaagggtaggggatacgaggtggacagcctacgtaacgtacttacgttgacgttcgtacgggtaccgg

SEQ ID NO: 102745 - DNA, 551 bp, Homo sapiens
  misc_feature: GYAE6OF02FVC82.8.19.B08.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccacccagttagcctggtaccaacacaaacctggccaggcctcccaggcccctnatctttgatgcatccatcgaggccatggcatcccagccaggttcagtggcagtggtctgggacagacttcactctcaccatcagcagcctagacgcctagagtatttgctaagtttattactgtactaactactacgtacgagtcggcccgtccggggcctaccgtttcggcccgtacgggaacctaaacgttgaacgactacgaaacgtactggtaggcgtacgccacctactcttgtccttctacttcccttcccgcctatccg

SEQ ID NO: 102746 - DNA, 556 bp, Homo sapiens
  misc_feature: GYAE6OF02G7RS0.8.19.B08.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (432)..(432): a, c, t, g, unknown or other
  misc_feature (432)..(432): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctnatctttgatgcatccatcagggccactggcactcccagccaggttcaggtggcaggtgggtctgggacagacttcactctcacatcagcagcctagacgcctagaagtagttttgcttaagtttattactgtacaactatacgtaccgngtcggccgtccggggcctacgtttccggcccgtacgggaacctaaagttcgagtactacgaaacgacgtgtcggacgtcgacaccgtatccgttgttcttcacttcccttacccgcctattccg

SEQ ID NO: 102747 - DNA, 589 bp, Homo sapiens
  misc_feature: GYAE6OF02IDN8B.8.19.B08.1.454.CMB.1.raw
  modified_base (196)..(196): a, c, t, g, unknown or other
  misc_feature (196)..(196): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (535)..(535): a, c, t, g, unknown or other
  misc_feature (535)..(535): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctccagataccaccggagagattgtgttgacacagtctccagccaccctgtctttgtctccgaggggaaanagccaccctctcctgcgagggccagtcagagtcgttaccaccagttacgcctaggtacccaaanacaaaaccgtggccaacggcctccccgaggcccctanacgttctttgatcgcatcccatcgacgggccacgtggcactccgagcctaggttcaggtggcgaggtggtctaggggacagacttcaactcgtcacatcaaggtcacgcctaagcnctagaagtntttgcttagtttattcagttcaagtactacgaccgtagtcggaccgtccgggcttaccgttcggcccgtagggaacctaaagttgacgtacacgaaacgtagtcggtgtacgngacctacacgttacgttcgttactccgtacttacccgtccctccgtagttaccg

SEQ ID NO: 102748 - DNA, 585 bp, Homo sapiens
  misc_feature: GYAE6OF02G9WN4.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaagagccaccctctcctgcaggccagtcagagtgtaccaccagttagcctggtaccaacacaaactgccaggctcccaggccctcatcttgatgcatccatcagggccactggcacgtcccagccaggtcagtggacagtgggtctgggacagacttcgactctacactagtcagcagcctagacgcctagaagtatttgacttagtttattacgtagtacaactactacgtaacgtagtcggtccgtccggggtcctaccggtttccggacccgtacgggaaccgtaaggtacgaacgtaacgtaacgaaaacgtacgttaggtacggacgtcggacctaccgtacgttccgttagttccttacacgttcccttcccgacctacgtaccg

SEQ ID NO: 102749 - DNA, 956 bp, Homo sapiens
  misc_feature: GYAE6OF02H9EG2.8.19.B08.1.454.CMB.1.raw
  modified_base (165)..(165): a, c, t, g, unknown or other
  misc_feature (165)..(165): n is a, c, g, or t
tcagctcgcgtgtccacgaccggtgctcgattttagtgagtcagtaagggggaggaactgctccagttacggacccgagtagggaaccgattggaagtccccgagctcaggcttctaccttcctccgtgacttacctcctggctcccgtaggataccgaaccggngaggtattttggttgttggacctaacgttaaggtctcccaggcctaccgtggttcttcgtctccgaagggggaagacgtcccgtacccggtctccgttggaccgaggggcccgtagggtccaggacgttacgttaccccacccgtagttacgccgttaggtaaccccaaacaaccgaaaccttcggaccctaagggcctacccgtaggtccccctacagttccgttttaggacgttcggtaccacttaccgacgttaccggaaggggtacccgacgtggggacctaccgtccccgaacgtacccgtagggtttaccgtaagggttgggtcggtaagggttcggggtacggttacgggggaacctaaacgggtacctttacccgaaaccgttccgtaacccgtaacccgttagttaccgaacggggtcccgtaagtaccccgtaaggtaccgtacccgttaaggaaacgtttaacgtttacgtaaccgttaaagtttaacccttaacgtacgttaaactaaacccgttagttaaccggtaaaccgtaggttacccgggtaccccgggttacccgggggtaccttaaaccgggttttacccgggaccccggttaaaggggtaaaccccgttaaaacgggtttaccgggtaaaacgttaaccggtaaaccgttaaaaccgggtaacggtttacggggaaccgggttaccgtaacgggaacctaaccggtacgtttacgtacgttaccgtttaccggtaccttttcccgttacccgttaaccctagttaccccgg

SEQ ID NO: 102750 - DNA, 541 bp, Homo sapiens
  misc_feature: GYAE6OF02HS9Y8.8.19.B08.1.454.CMB.1.raw
  modified_base (303)..(303): a, c, t, g, unknown or other
  misc_feature (303)..(303): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccaggtgaactcccagccaggttcagcggcaggtgggtctggggactttcgttcactctcaccatcaaataacctgacaatctgacgtactttgctagtttatttctgtcagctagtctagaacgtactcggcccgtttcacgttttcgggacgggtacgggaaccgaagggtcggaccctacgaaaacgaactggtgctagcacatctgtctnactctcccncactcganaccg

SEQ ID NO: 102751 - DNA, 546 bp, Homo sapiens
  misc_feature: GYAE6OF02IZXHV.8.19.B08.1.454.CMB.1.raw
  modified_base (292)..(292): a, c, t, g, unknown or other
  misc_feature (292)..(292): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtgggggggctggtccagcctgggagtccctgagactctcctgtgcaggctctggattcaccttcagtaactacggcgtgcactgggtccnccaggctccaggcaagggcttggagtggctggctagttgttcatctagaaggatgtacaatactatacagactcgtgaaggcatcacatctcagagacaataccaagaacacgatagtactctagacaagtgacagacctaagagtagacggacacggtcgttagtttactacgtagtacgaaggaggggtatacggaggtacggacgtacgacgtacgaacgtacttacgttacgtacgttcgtgggtaccgg

SEQ ID NO: 102752 - DNA, 690 bp, Homo sapiens
  misc_feature: GYAE6OF02GOS1D.8.19.B08.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggcctccacggcccctnatcctttgatgcatccatcgagggccacgtggccactcccgagccaggttcagtgggctagggtcgggtctacggggacagtaccttcgacttctaccaccatcagccacgtcccgtagacgccttaggaagttacgttttagcctttaagttttaacttacgttacgtactaaccgtacgttaccggttaaccggaggttcgggtcccgtcccggggggacccttaccggtttacccgggtaccccggttacggggtaaaccccttaaaaggtttacgaacgtaacgttaaccgaaaccgtaacgttacggtacgggtaccgtcggtacccaacccgtacttacccgtttagttaccgtttacccttaccgtttccccgtaccccggttaccctacttacccgg

SEQ ID NO: 102753 - DNA, 720 bp, Homo sapiens
  misc_feature: GYAE6OF02F35IB.8.19.B08.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtcgttaccaccagttacgcctggtaccaacacaaacctggaccaggcctccgacggcccctnactctttgatgcatccatcgaggccacgtggacctactccccgagcccgtaaggttccaggtcggactaggtcggggtcctaggggactaaggtcctttacgaaccttctccgaacctagtccgaacgtaccgacgtacccctaaggaccggtacccgtaacggtaaagttacgtttttacggacgttaagttttaactttacgttacgttaactaacgtacgttaccgtaacccgtaggttccgggtcccggtacccgggggtacccttaccggtttacccgggtacccgttacggggtaaacctaaacggttcgaaacggtacgttaacgtaaaccgtaccgttaggtacggtccgtaacgtaccgtaacctaacgttccgttacgttaccgtttactaccttcccggttaccccgtccgtacttaccgg

SEQ ID NO: 102754 - DNA, 609 bp, Homo sapiens
  misc_feature: GYAE6OF02F7K3I.8.19.B08.1.454.CMB.1.raw
  modified_base (386)..(386): a, c, t, g, unknown or other
  misc_feature (386)..(386): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgccagggccagtcagagtgttaccacccagttacgcctggtaccaaacacaaacctggccaggcctcccgaggcccctcatctttgatgccatcccatccagggccacgtggcatccccagccaggttcaggtggcaggtcggtctgggacagccttcactcgtccaccatcagcngacctagacgcctagaagtagtttgtactagtttattactcgtacaactacgtacgttaccgagtcggccggtcccggggtccctacgtttcccgggcccttacggggtaaccctaaacgttcgaacgtactacgaaacgtacgttacgtacggtcgtacggacccgaccgtacgttccgttcgttaccttactaccgttccgttaccccgtcctacgtaccg

SEQ ID NO: 102755 - DNA, 601 bp, Homo sapiens
  misc_feature: GYAE6OF02HE0CA.8.19.B08.1.454.CMB.1.raw
  modified_base (194)..(194): a, c, t, g, unknown or other
  misc_feature (194)..(194): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgctccaggggaancgccaccctctcctgcagggccagtcagagtcgttaccacccagttacgcctaggtaaccaacacaaaccgtggaccaggcctacccgacggcccctcacttcctttgactgcactccatcgacgggccaacgtggccactcccagccaggttcaggtggcaggtggtctgggacagacttcactctcacatcagcacgcctagacgctagtaagtatttgacttaagtttacttatacgtacaactatacgtaccgtagtcggtccgtccgggtctaccgttccggccgtacgggaacctaaagttcgaacgtactaacgaaacgtaacgtacgtacggccgtacgtaccaacctagttaccgtgttaccttaccgtacttacccttacccggtacctacttaccg

SEQ ID NO: 102756 - DNA, 783 bp, Homo sapiens
  misc_feature: GYAE6OF02HS4FY.8.19.B08.1.454.CMB.1.raw
  modified_base (307)..(307): a, c, t, g, unknown or other
  misc_feature (307)..(307): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaagggaaagagccaccctctcctgcgacgggcctagtcagagtcgttaaccacccaggttacgcctaggtaacccaaacaccaaaaccgtggacccagggcctacccgacggtcccctnacttctttgatcgcatccatcgacgggccacgtcggactacctaccccaacggtacctagggttaccaagggttcgggaccgtaagggttcgggggttacctacggggggaaacctaacgggtaccctttacgaacccctttccgaacctaaccccggtaattacgaccggactaacggtacccgttaaggaccgacccgttaaggaaacggttttacttttacggtacctttaacggttttaaactttaccgtgttaaccaaacttacggtccgtaacggtacggtacgggtcccggtacccgggggtccttacccgggttttacccggtccccgtaaaccgggggaacctttaaaacgtcggtaaagaaccttaaaccggaaacgttaaccgtgggtaccggtacgtacggacctaaccgtacgttctaccgttacttaccgtacctttacccgttcccgtaccttcgtaaccg

SEQ ID NO: 102757 - DNA, 947 bp, Homo sapiens
  misc_feature: GYAE6OF02FFJKW.8.19.B08.1.454.CMB.1.raw
tcagctcgcgtgtccacgaccggtgctcgatttagtgagtcagtaaggggggagaggagcccagcactagaagtcggcggtgtttccattcggtgatcagcactcaacacagaggactcaccatggagtttgggctgagcgttggttttcctcgttgcttacttttaaggaggtcgtccagtgtacaagtgacaacgtggtggagttcgggtcggggggcgtcggtaccgacgtccgtgggggacgtcccgtaggacgaccttcctccgtggtcgacggagggtaccgttaggtaatttcgaacgttttccgttttagggacgtaactttagttcggtcgttcggttaccgtacccgggttcgggggtcccccgaccggtacgggtccccgttaaccggggaaggggggtaacgggtccgttaggggtaaggttaacggggttaacgttccgtaacgtaaagtttaaagggtaaaaacgttaaacggttccgttttaaggtcgggggttaaccgggtaaacaaaacgtacggtaacgtttaaccccggcccgttacggttacgtggtaaagggaaacggtccaaaggttaccttacccgaacctacgttaccgtaacgaaaggagtaacgtacgttaaacttaaacccgaaaacgtacctaacgttaccccgtttaccttttaaccgaaaccgttaaaaggttcccgggaaaaccgtaccggtaacccgttaaaacgggaaaaacccggacgggtaaacccaaccgggtaacgggttaccgtttaaaggttaacccgtttaaacgtacgtaaacccgtaacgggttttacggggttttaccgggtaaccgggtaaaaccttcccggaaaacttaaaacgtccggtaacccgttggggtaccgggaacccgggaaccgggttaacccgtcgggttaccccctacccgg

SEQ ID NO: 102758 - DNA, 779 bp, Homo sapiens
  misc_feature: GYAE6OF02HSKML.8.19.B08.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgttctttgtctccgaggggaaancgccaccctctcctgcgacgggccagtcagagtcgttaccaccctagttacgcctggtaccaacaacaaaccgtggccaggcctcccacggcccctcattctttgactgcactccatccgacgggccacgtcggacctacctccccgagtcccgtaggtttccaacgggtcgggacctagggttcggggttaccgtacgggggaaccacggtacctttccgaacttccttaccaaccctacttacgaaccggcccgaacggtacccttaacggacgtacccgtaggtaaacgtttacgttttcgtacgtttaaggttttaactttacgttacgtaactaaccttaacgttaccggttacccggtacgggttaccgggtccccgggttacccgggggtcccttacccgggtttcccgggtaccccggttaaccggggtaaaccgttaaaggttcgtaaacgtaacgtaaaccgtaaacgttaaccgttacggttacggtacgtacggtaccctaccgtaccttaccgttacgtttaccgttaccgtaccgtttccccgtttaccccgtaccttacgttaccg

SEQ ID NO: 102759 - DNA, 609 bp, Homo sapiens
  misc_feature: GYAE6OF02GVJI8.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttacgcctggtaccaacacaaacctggccaggcctcccaggcccctcattcttgatgcatccatcgagggccacgtggacatcccagccaggttcaggttggcaggtgggtctgggtactttcggtcacttctcacctatactaaatacctgacctaagtctagacctatttgacttaagttttattctgtacacgtctagttctagtaacgtcgttcgggtacccgtttcgtaccgttttcgggacgggacgggtaaccgaagggttcgaaccttaacgaaacgtaacgtgtacggtctcgacgtaccctattccgtacgttccttacgtacttcccgtttaccccgaccttacgttccgtacgtaaccg

SEQ ID NO: 102760 - DNA, 726 bp, Homo sapiens
  misc_feature: GYAE6OF02IJ88I.8.19.B08.1.454.CMB.1.raw
  modified_base (200)..(200): a, c, t, g, unknown or other
  misc_feature (200)..(200): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggcctcccagataccaccggagagattgtgttgacacagtcctccagcccaccctgtctttgctaccgaggggaaanagccaccctctcctgcacgggcccagtcagagttcgttaccacccagttacgcctaggtacccaacacaaaccgtggaccaggacctcccaggcccctcacttcgtttagatcgacatccaatccgacgggtccacgcggacacctcccgagtaccaaggttcgagtggactacggttgggcgtacgggacacggtacttcgaactctacaccaagttccgagaccacgacccgtagtacgtccttaggaagttacgttttcgtacttacgttttattaccgttaggtactaaacttacgttacgtaaccggtacggttccgggtaccggtcccggggtaccttaccggttacccgggtaccccggttacggggaaacccttaaacggttcggtaacggtaaacgtaccgtaaaaaccgtacggttaccgtaccgggtaccgtacgaacccgtaaccgtaactttaccggttagttttccccgtacttaccgtttaccccggttaccccgtacgtaccttaaccgg

SEQ ID NO: 102761 - DNA, 708 bp, Homo sapiens
  misc_feature: GYAE6OF02IP95Z.8.19.B08.1.454.CMB.1.raw
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
  modified_base (385)..(385): a, c, t, g, unknown or other
  misc_feature (385)..(385): n is a, c, g, or t
tcagctcgcgtgtccacgaccggtgctcgattttagtgagtcagtaaaggggggggagagggacgccccagccactagaagtcggcgggtgtttccagttcggtgatcagtcactgaacacagaggactcaccatggagtttgggctggagcgttgggttttcctcggttgcttcttttaagacggtcgtccagtgtcaagtgccacctggtgagtcgtggggggcctcggtccngcctgggaggtccctgagactcgtcctggtgcgacggcctctggacttcaccttcagtaactacggcgtgcacgtgggtccncacggcctccagggcgaagggcttgggagtggctggctagttgtttcatcgtagaaggtagttgttanaattactatacagtactccggtagaacggggcctagttccaacccgtattccctacccagaacgtaacctaaactttacccaaaaggaaccaaacgtatacgtatcctagaaccgtaaagtacgggacaacggtaccttaaggtacgttacggaggtaccgtacggtcctttaggtttttaactaccggttaagggtaaacggtaaacgggggagggggtaacgttaacggagggtttaaggacccggtaaggtacccgtaaccgtaagttaacccgtttaccgttttacggtaccgttttccggtaccgggggtaaccccgg

SEQ ID NO: 102762 - DNA, 640 bp, Homo sapiens
  misc_feature: GYAE6OF02IIN8F.8.19.B08.1.454.CMB.1.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (368)..(368): a, c, t, g, unknown or other
  misc_feature (368)..(368): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattggtgttgaacacagtctccagccaccctgtctttgtctccgaggggaaangccaccctctcctgcagggccagtcagagtcgtaccaccagttancctaggtaccaacacaaacctggacccaggcctcccgacggcccctgattcttgactgctatccatcgaagggccagtcggacacgtcccagcctaggttcaggtggacaggtggctgggaacngtacttcgactcacacgtatcgagtcaactccgtaagacgccgtagaacgtagtttcgacgtaagttttacgttactgtacaacgtactacggtacgtacgtcgtaccggtccggggtaccttaccggttaccggtcccgtacgggtaaacctaaacgttacggaacgtactaaccgaaacgttacgtacggtacggtacgtacggaccgtaaccacgttaccgttacggtacctttacgtaccgttccgttaccccggtacctacgttccg

SEQ ID NO: 102763 - DNA, 527 bp, Homo sapiens
  misc_feature: GYAE6OF02I0R3N.8.19.B08.1.454.CMB.1.raw
  modified_base (438)..(438): a, c, t, g, unknown or other
  misc_feature (438)..(438): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (524)..(524): a, c, t, g, unknown or other
  misc_feature (524)..(524): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttacgcctggtaccaacacaaacctggccaggcctcccaggcccctcatctttgatgcatccatcgagggccactggcactccccagccaggttcaggtcggcaggtggctgggacaggacttcactctcacctatccagcacgcctagacgcctagaagttatttgcttagtttacttactgtacaactatcgtacgngtcggccgtccgggcctcgttccggccgtaggaacctaagtgaganacaacgactgngcgtcgcacntctntctcatcctccgctntcg

SEQ ID NO: 102764 - DNA, 738 bp, Homo sapiens
  misc_feature: GYAE6OF02II33S.8.19.B08.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggcctcccagataccaccggagagattgtgttgacacagtctccagccctacctgtctttcgtctccgaggggaaancgccaccctctccngcgacgggccagtcagagttcgtaccaccagttcgctggtaacaacacaacctgaccaggcctacccgacggccctacgtacttcgttgactcgctactaccagtccgacggacctacgtcggccaactcccgaacgtccgtaacggttcgaacggtcggacgtacgggttcgggtaccgtaggggacctagtaccgttccgtactacgtaccacctagtaccaggttaccgaccggtacttacggactacccgtaggtaaactttacgttttcgactttaacggttttacttaacgtagtaaccgaattaacgttaccgacgtaacgggtccggtccggttaccggggtacctttaccgggttaccggtaccccgttacgggtaaaacccttaagtacggtaacggtaactaacgtaaaccggtacgtacggttacggacgtaacggtaccgtaaccgtacgtttacccgttacgtttaccgttaccttaccggttccccgttaccccgtacttcgtaaccgg

SEQ ID NO: 102765 - DNA, 556 bp, Homo sapiens
  misc_feature: GYAE6OF02FVRHN.8.19.B08.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccgggagagattgtgttgacacagtctccagccaccctgtcttgtctccaggggaaanagccaccctctcctgcagggccagtcagagtgttacccacccagttagcctggtaccaacacaaacctggccaggctcccaggcccctcatctttgatgcatccatcaggccactggcatccanccaggttcagtggcagtggtctgggacagacttcactctcaccatcacgcacgcctagacgcctaggaagtattttcgctagtttaacttactgtactaactactcgtaccgacgtcggccgtccgggggtcctacgttccggcccgtacgggaccgaaagtcggaatacgtacgaacgaacgtgtcggcgtcgacacctactctcgtcttactacttccttacccgtcctactcg

SEQ ID NO: 102766 - DNA, 579 bp, Homo sapiens
  misc_feature: GYAE6OF02G13K9.8.19.B08.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaaggggaaanagccaccctctcctgcagggccagtcagagtcgttaccaccagttacgcctggtaccaacacaaacctggccaggctcccgaggcccctnactctttgatgcatccatcagggccacgtggcactcccagccaggttcaggtgcaggtggtctgggacagtctcnctctcacatcagcagactagacgcctagaagtatttcgacttagtttattactacgtacaactactaccgtacgtaggtcggccggttccgggggcccttacggtttcccggtacccgtacgggtaacccgtaaaagttcgaacgtactaaccgaaacgtacgtgtacggctcgaccacgtactcgtacgttcttctcttccgtccgactataccg

SEQ ID NO: 102767 - DNA, 636 bp, Homo sapiens
  misc_feature: GYAE6OF02HXX4Y.8.19.B08.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccgganagattgtgttgacacagtcctccagccacccttgtctttgctccaggggaaanacgccaccctctccngccagggccagtcagacgtgttaccaacccagttaacgcctggtaccaaaactaccaaaacctggccaggcctcccaggcccctnactcttgatgcatcatcaggccacnggcactcccagccgagtcagtggcngtggtctgggactanaccttcacttctccactatcagtaccagtaccctagagacctaggtaacgtaagttttcgactacgtttacttactacgttacgaactacgtacgtaaccggacgttcgccgtcccgggggcctaccgtttaccgggtccctacggggtaaacccgtaaacgttacgaaaggtacgtaaccgaaaacgtaacgtacgttacggtaccgtcggaccgtaacctaccttaccgtacgttccttaccgtacttcccttaccccgtaccgtactaccg

SEQ ID NO: 102768 - DNA, 600 bp, Homo sapiens
  misc_feature: GYAE6OF02IDUGN.8.19.B08.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagctcgcgtgtccacgaccggtgctcgatttagtgagtcagtaaggggaggaactgctcagttaggacccagagggaaccatggaagccccagctcagcttctcttcctcctgctactctggctccagataccaaccggngagattgtgttgacacagtctccagccacctgtctttgctccagggaancgccacctctcngacgagggccagtcagngttcgtaccaccgtagttacgccttggaccaanaccaacgtggccaaggctccaggcccnactctttgatgcatccatcaggcccagtcggcatccgagtccagttccagtgcaggtggtcncggactaggccttancgtctacgacctaatcgaagccgtaacncgttaacgcgtcacgtagttattcgacttagtttacgttcgtntactaacncgttacgtacggtacgtcggtacgtaccggggacttaccgtccggtaccgtcggtaaccgtaacgttcgacgttagaaccgtaacgacttccggtagtacgtaagccgtacgtaacgttcgttaccgtcgttaactcctttacccgtacgaccttagtaacccg

SEQ ID NO: 102769 - DNA, 703 bp, Homo sapiens
  misc_feature: GYAE6OF02JZCZG.8.19.B08.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgagtcagtaagggggaggaactgctcagttaggacccagagggaaccatggaatccccagctcagcttctcttcctcctgctactctggctcccagataccaccggagagattgtgttgacacagtctccagccaccctgtctttgtctccgaggggaanagccaccctctcctgcagggccagtcagtgtcgttaccacccgtagttacgcctaggtaccaacaccaaaccgtggccaggcctcccgacggcccctcattctttgacttcgcatccatcgacggcccagtggccactcccagcccgtaggttcaggtcggctacggttcggggtctaggggactagtctttccgacgttcctaccaccgtattccagggacccacggtcccgtaaggacgtacctaggtaaacgtttagttttcgtaacttaagttttacttaacgttacgtaccgtaacgttaacgtttccggtaaccggttacggtcccgggtacccgggttacccggggtaccctttacccgggttttacccggggacccgtttacgggaaacccgttaaagtttccggaaacgtaacgtaaccgtaaaccgtacgtcgtaggtccggtacacgtacctagttccttacgttaccttctacctccgttaccctctacgtaccg

SEQ ID NO: 102770 - DNA, 608 bp, Homo sapiens
  misc_feature: GYAE6OF02FM1YK.8.19.B08.1.454.CMB.1.raw
tcagctcgcgtgtccacgaccggtgctcgatttagtgagtcagtaaggggggaggaactgctcagttaggacccagagggaaccatggaagccccagctcagcttctcttcctcctgctactctggctcccagataccaccggagagattgtgttgacacagtctccagccaccctgtctttgtctccaaggggaaagagccaccctctcctgcagggccagtcagagtgttaccacccagttacgcctggtaccaacacaaacctggccaggcctcccacggcccctcatctttgatgcatccatcaggccactggcatcccagccaaggttcagtcggcaggtgggtcgtgggacagtacttcactctcaccatcgacgcaggcctagagtctagaagtattttcggactagttttacttaactgtactaaacgtactacgtaccgtacggtcggtcccggtccggggccctacgtttccgggcccgtagggtaaccctaaaagtttcgaacgtaacgtaaccgaaacgtaaccgtacgtcggtacgtcggacctaccgacttcgttcgttacttccgtacttcccgtttacccgcctacttaccg

SEQ ID NO: 102771 - DNA, 230 bp, Homo sapiens
  misc_feature: GYAE6OF02IUEJN.8.19.B08.1.454.CMB.1.raw
  modified_base (105)..(105): a, c, t, g, unknown or other
  misc_feature (105)..(105): n is a, c, g, or t
  modified_base (122)..(122): a, c, t, g, unknown or other
  misc_feature (122)..(122): n is a, c, g, or t
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (191)..(230): a, c, t, g, unknown or other
  misc_feature (191)..(230): n is a, c, g, or t
tcagctcgcgtgtccacgaccggtgctcgatttagtgagtcagtaagggggaggaactgctcagttaggacccagagggaaccatggaagccccagctcagcttntcttcctcctgctactntgctccagactaccacgagagattgtcgtagacacatcncganaccncctgtctgtctccgaaaggnannnnnnnnnnnnnnnnnnnnnnnnnnnnnnnnnnnnnnnn

SEQ ID NO: 102772 - DNA, 735 bp, Homo sapiens
  misc_feature: GYAE6OF02H3LDV.8.19.B08.1.454.CMB.1.raw
  modified_base (137)..(137): a, c, t, g, unknown or other
  misc_feature (137)..(137): n is a, c, g, or t
tcagctcgcgtgtccacgaccggtgctcgatttagtgagtcagtaaggggggagaggagcccagcactagaagtcggcggtgtttccattcggtgatcagcactgaacacagagactcacatggagtttgggctganctgggttttcctcgttgctcttttaagaggtgtccagtgtcaagtgcaacgtggtggagtcggtggggggggtctggtccagccgtggggacggtccctgagacctctcctgtgctaggctcgtggtattcaccttcagtaaaccgtcggcgtgctacgtgggtccaccgaggcctccgaggtacgaagggtccttaggagttcggctcggacttagtttcgttacagttcgtaggaaaggtagtgttaccaaataacgtaatactaacggactccgtaggaaacgggtccctaattcctaaaccgtcttaccgtaccgaacgaacgtaaacttaacgttaccaaaacgtaaccctaacggtaatacggttaactacgttaacgtaaccgtaaagtacgggaaccgtaggtaaccgttaaaggtaacggtttaaggaaccggtaaaccgtaccggggttaactttacgtttaaccgtttaacggtaacggttaaacggggaacgggtaagggggtaactaacggtaggtacggtacgtacgtacgtaaccgtagttaccgttacgtttacggtaccggttacggtaccgggtaaccgg

SEQ ID NO: 102773 - DNA, 585 bp, Homo sapiens
  misc_feature: GYAE6OF02HIXP0.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagacctctcctgtgcaggctctggattcaccttcagtaactacggcgtgcacgtgggtcccgccaggcctccgaggccaaggggcttgggagtggctggctagtttgtttcatcgtaggaaggtagttgttcaatactatacagactcgtagaacggccgattcacatcctacagagacaattccaagaacacgatgtactctagacaaagtcggacacgaccgtaagacgttagacggacgacggtcgttgtttaacgttacgtagtacggaagggacgggggtatacggtaggtcggacacgcctacgaacgttacgtactttacggtacttcggtcgggtacccgg

SEQ ID NO: 102774 - DNA, 623 bp, Homo sapiens
  misc_feature: GYAE6OF02JPB7K.8.19.B08.1.454.CMB.1.raw
  modified_base (397)..(397): a, c, t, g, unknown or other
  misc_feature (397)..(397): n is a, c, g, or t
tcagctcgcgtgtccacgaccggtgctcgatttagtgagtcagtaagggggaggaactgctcagttaggacccagagggaaccatggaagccccagctcagcttctcttcctctgctactctggctcccagataccaccggagagattgtgttgacacagtctccagccacctgtctttgtctccgaggggaagagccaccctctcctgcgacgggccagtcaagagtcgttaccacccagttagcctaggtaccaacacaaacctggccaggcctcccacggcccctcatcctttgatgcaactccatcgacgggccacgtcggcactccccaggcctacgggttcaggtcggctaggtcgggtctggggacaggtactttcgactcgacaccgtntcacgcaacgcctagacgcctagtaagtatttcgacttagtttattacgtcgtacaactacgtaccgtacgacgttcgggtaccggtcccggggtccttaaccgttccggaccgtacggtaacctaacgttgaacgtaactaacgtaaacgtaccgtagtcgtaccggtcgtaccacgtacgttcgttacgtccgtttacaccgttccttcccgtactcgtaccgg

SEQ ID NO: 102775 - DNA, 875 bp, Homo sapiens
  misc_feature: GYAE6OF02GWYP8.8.19.B08.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagcccagctcagcttctcttcctcctgctactctggctcccagactaccaccgggagagattgtgttgacacagtctccagccaccctgtctttgctccgaggggaaagngcccaccctctccgtgcgagggccagtcagagtcgttaccaccagttacgcctggtaccaacacaaacctggccaggctcccaggcccctcatcttgatgcatccatcgacgggccacgtggccacgtcccacgcctaaggttcaggttcggacgtaggtcggggttcgtagggggaacctacggtaccttaccgtaccttctccaaccctagttacccacgggaccacggtacccttaaggaaccggtccccgttaaagggtaaacggtttaacgtttttacgggtaccggtttaaacgttttttaacgtttaaccgtttacggttaaccctaaaaccgttaacggtttaacccgggtttaacccgggtaaacgggtttccgggggttacccccgggtttacccccgggggggttaccccgttaacccgggtttttacccccgggggtacccccgggttttaaacggggggtaaaaccccgttaaaaaacggttttccgggaaaaccggttaaaccgttaaacccggtaaaaaacccggttaaccggttacggggttaccgggtacccgttaaccggtaaccgttaaaccccggtaactttacccggtttaacggtttccctttaaccgttaccctttaccccggtttaccccccgtacgttaccttaaccccggg

SEQ ID NO: 102776 - DNA, 972 bp, Homo sapiens
  misc_feature: GYAE6OF02HF397.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagcccaccctgttctttgtcctccgaaggggaaagagcccaccctctcctgcgacgggccagtcgagtagttcgttacccacccagttacgcctacggtaacccaaacaaccaaaccgtcggacccacgggaccctccccgaaccggccccctactacttccgttttagacttcggacctactacccgtagtaccgacggggtaccctaaccggtcgggaccctaaccgttacccccgaacggaccccgttagggtttaccgacggttacggggtacccgtaggggttcgggggtaccgttacgggggaacctaacgggtaccctttaccgtaaccttcccttaaccgaaccctacgtacccgtacgacccgtaaaccggtcccgtaaacgggaacccgttacccgtaaagggttaaaccgttttaaacctttttcggggaacccttttaaaggttttttaaacctttaccggtaaccggttaacccaaaaaccggttaccttttaaaccccgggtaaaccgggttcgggttcccgggggttaccccccgggggtttacccgggggttaacccccgttaacccgggtttttaccccgggggacccccggttttaaaccgggggtaaaaacccgtttaaaaccgggttttgggaaacccggtaaacccggtttaaaccgtaaaaaccgggttaaccgggtttccggtacggttacccgtaccggaacccgttaaccctggtttacccgttaccttttcccttaccgtacccgtttacccccgttaccccgtattacccggttacccg

SEQ ID NO: 102777 - DNA, 844 bp, Homo sapiens
  misc_feature: GYAE6OF02IWQLE.8.19.B08.1.454.CMB.1.raw
  modified_base (201)..(201): a, c, t, g, unknown or other
  misc_feature (201)..(201): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacgagtctccagcccaccctgttctttgtctccgaaggggaaancgcccaccctctcctgcgacgggccagtcagtagttcgttaccaccgtagttacgcctacggtaaccaaacaacctaaaccgtcggaccgacggtcctaccccgaacggtccccctactaactttccgttttacggacgttcgacctacgttacccgtaacgttaccggaacggggaccctaaccggttcgggaccctaaccgttaccccggaacggtacccgttaacgggtttaccgaacgggttacgggacgttaacgggttcgggggtaccgttacgggggaacctaaccgggtacctttaccgaaccctttccgtacccaaccgtacgttaccgaacgtccgtaaccggtcccgttaacggacgtcccgttaaaggttaaacgtttacgttttacgaacgtttaagtttttaacttacgttacggtaacctaaacgttacgttaccggtaaccgtacggttccgggtaccccggttcccggggtacctttacccggttttcccgggacccgttaacggggtaaaccttaaaacgtttcgaaacgtaacgaaccgtaaacgtaccttgggtacgtcgtacgacctactacgttcctcggttaccttactaccgtttcccgtaccccgtactacgttaccg

SEQ ID NO: 102778 - DNA, 836 bp, Homo sapiens
  misc_feature: GYAE6OF02JY5DR.8.19.B08.1.454.CMB.1.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
tcagctcgcgtgtccacgaccggtgctcgatttagtgagtcagtaagggggaggaactgctcagttaggacccagagggaaccatggaagcccagctcagcttcgtcttcctcctgctactcgtggctcccgagataccaccgggagagattcgtgttgacgactagtctccagccaccctgtctttgtctccgaggggaancgcctacctctcctgcacgggccagtcagagtcgttaacccaccgaggttacnccgtaggtaccaacacaaacctggaccaggcctccaggccctcacttcttgactgactactacctatcggaggccctatggacctntaccccgagtccgagggttacaggtcggactaggttcggggtctacggggacctaggtaccttactaacccgttctacctaaacctcttaaccgggactacccgtaagggaccgttacgaaccggtaccgtaggttaaacgttaacgttttggaccgtttaagttttacttacggttacggtaaccaaaccgttactttaacccggggtaaccgtaaggggtacccggtttacccgggaccccgggggtttaccgtacccggttttacccggggtaaccccgttaacggggttaaacccgtaaaacgggttttaccggaaaggtaaaccccggttaaaccgttaaaacccggttaacgggttccgggttaaccggttacccggttcggggttaaaccctacccggttaactttaccccggggttaattttccccgtttaaccgtttaccccgggtttacccttaaccccgggttaccccttacggttaaccccgg

SEQ ID NO: 102779 - DNA, 894 bp, Homo sapiens
  misc_feature: GYAE6OF02JXA0T.8.19.B08.1.454.CMB.1.raw
  modified_base (551)..(551): a, c, t, g, unknown or other
  misc_feature (551)..(551): n is a, c, g, or t
tcagctcgcgtgtccacgaccggtgctcgatttagtgagtcagtaagggggaggaactgctcagttaggacccagagggaaccatggaagcccagctcagcttctctcctcctgctactctggctcccagactaccacggagagattgtgtgacacagtctcgacgcctaccgtgttctttggtacctaccggaaggggtaacgtaccggccctaccctccgttacctcggaccggacgggacctagtacgacggtacgttaccgtaccctacccgtagtttaccggacccgttacggtaacccaaacgaaccgtaaaacccgtcggaccccgtaacgggcccttaccccggaaccggtccccctacgtaaccgttccgttttaacggacttaccggacttaaccctccgtaacgtaccggtccgggaaccctcgttaccgggaacctccgttacccgaggtacccgtaacggttcgtaaggtccggtacgtacggggttcggtacgttacgggactacggtaaccgttccgacttaccgtcaacgttacncgaacgccgtaacgccgttacggacgtacgttacggtaagtttacgttcggtaacctttaaaggtttccttaacggttcaaacgtacttaaccggtttcggacggtttaccggaccggtcccgggtaccggggtaccttaccgggtttaccggaccccggtttacgggaaaccgttttaaccggtaggtaaaccgttaaaccgggtaacccttaaacggggttaccgtaccgggtacgtttaaccggaaccggttccgtaaaccctaccggttttaacggttccgttaaccgggttaccttccggttaccccggttaaccgttccccgttaagtttaccccgg

SEQ ID NO: 102780 - DNA, 670 bp, Homo sapiens
  misc_feature: GYAE6OF02FYG8K.8.19.B08.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaanagccaccctctcctgcaggccagtcagatgtggcgtcctacgtatcctggtacccaagacgaaacctggaccaggcctcccacggcccctcatctagtggtnctactaccgaacgacgggaccacgtggacactaccccagcccgtaggtttcgaggtcggacctaggtagggtagtggggacaggtaccttacgactcctactaccatcgacttcgacgtccgtacggacgtccgtaggacggtattggttcgtacgttaagttttacgtttacgttcgtactaacgttacgttaccgtaccggtaggtccggtccggtacccgggggtacccgttaccgtttcccgggtcccgttacggggtaacctaaacgggtaggtaacgtacgtaaccgaaacgtacggttcgtacggttacgtacgtacctaactacgtccgttcgttaccttacctacttcccttaccccg

SEQ ID NO: 102781 - DNA, 688 bp, Homo sapiens
  misc_feature: GYAE6OF02J0UNS.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgcttctttaagaggtgtccagtgtcaagtgcaacgtggtggagtcgtggggggggcgtggtccgagccgtgggaggtccctgacgactctcctgtgcaggtctcgtggtacttcctccttagacgttaaccgtacgggtcgtcgcacggttcgggtccgtccgaggtcctccgagggccaaggggtccgttagggaggtcggcgtcgggcgtagtttcgtttcagttcgtaggaacgggtagttcgttacaaacgttactactaacgacgtacgtccggtaggaacggtccgtactaccacctactcctaccgaagacgtacctaaacgtaccaacgtaaaccacgtacttagtactactagtacaaagtcgaacagtactaaggtcgtacgaaggtacgacggttctttagttaacttacgtaggttaaacggaaggggtagggacgttaacggacggtaggaccgtcgtaaccgttaccgtaacgtttaccgttaccgttttagaccggtttaccggaggggtaccccgg

SEQ ID NO: 102782 - DNA, 602 bp, Homo sapiens
  misc_feature: GYAE6OF02JMTMF.8.19.B08.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (433)..(433): a, c, t, g, unknown or other
  misc_feature (433)..(433): n is a, c, g, or t
  modified_base (561)..(561): a, c, t, g, unknown or other
  misc_feature (561)..(561): n is a, c, g, or t
  modified_base (594)..(594): a, c, t, g, unknown or other
  misc_feature (594)..(594): n is a, c, g, or t
tcagctcgcgtgtccacgaccggtgctcgatttagtgagtcagtaagggggagggaactgctcagttaggacccagagggaaccatggaagccccagctcagcttctcttcctcctgctactctggctcccagataccaccggagagattgtgttgacacagtctccagcccacctgtctttgtctccgaggggaaangccaccctctcctgcagggccagtcagagtcgttaccacctagttacgccgttaggtaaccaacacaaacctcggaccaggcctacccgacggccccctnactcttagactcgcactccatcgacggccaactggacactcccagcctaggttacagtcggacgtaggtcgggtacnggggactagccttcactctacacgtatccgagcacggactagaccgtactaggaattntttacgattaagttttatactagtaccactacgttacgtacgtgtacgccgtccgggtcctacgttccgtccgtacgtaactaacgttcgagtacgtaacgaacgtcgtagtacgtcgtagactaccngttcgtcgtacttacgtaccttccgtacccgtntacgtacg

SEQ ID NO: 102783 - DNA, 710 bp, Homo sapiens
  misc_feature: GYAE6OF02IU3K0.8.19.B08.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgttctttgtctccgaggggaaanacgccaccctctcctgcagggccagtcagagtcgttacccacccagttacgcctacggtaccaaacaccaaacccgtggccaacggcctaccccgaggcccccttcacttctttgatgcacttccatccgacggggacctacgtcgggaccacttccccgaacgcccgtagggtttccaggttcggacgtaggtcggggttctggggacctaggtacctttcgacttctaccgacctactacgacgccagtaccgtagaccgccgtaggaagttagtttacgacgttagtttattaccgtagttaccaacgttacgtacgtacgtacggtccggtcccggtaccgggggcccttaccggttcggtaccccggtacggaacctaaacgttcgaacgtaacgttaaccgaacgtaaccgtgggtacgtaccgtacgtacccaaccgttaccttcgttaccggttaccgtttaccttaccgtttccgtttacccccggtacctaccgttacccgg

SEQ ID NO: 102784 - DNA, 698 bp, Homo sapiens
  misc_feature: GYAE6OF02IHIV6.8.19.B08.1.454.CMB.1.raw
  modified_base (151)..(151): a, c, t, g, unknown or other
  misc_feature (151)..(151): n is a, c, g, or t
  modified_base (377)..(377): a, c, t, g, unknown or other
  misc_feature (377)..(377): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgngttgacacagtcctccagccaccctgttcttgtctccgaggggaaagacgccaccctctcctgcagggccagtcagtcgttcgttacccacccagttagcctcggtaaccaaccgaacaaacccgtggaccacggcctccccgacggccccctcactcctttgatgacactcctatccgacgggccaccgtgaccactcccacgcctaggtcacggtggactcggnggtcgtcgggactacgtacttcactcgactaccactcgacgcacgcctagcgtacctagtaaacgttatttcgatttagtttaacttaccgttatacctaaacgtgtacccggtaacggtcggtcggaccccgggttcccggggtccttacccgggtttcccgggaacccggtttaccgggtaaaccttaaacggttacggaaacggttaccgtaaaccggtaaaccgtaaccggttcgcggtaccgtcgtaaccgaccttacgttccggtttacgttccttaaccgttccgttaccccgtttcccggaccttcgttaccg

SEQ ID NO: 102785 - DNA, 634 bp, Homo sapiens
  misc_feature: GYAE6OF02GVQNW.8.19.B08.1.454.CMB.1.raw
  modified_base (238)..(238): a, c, t, g, unknown or other
  misc_feature (238)..(238): n is a, c, g, or t
  modified_base (594)..(594): a, c, t, g, unknown or other
  misc_feature (594)..(594): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccagggaagacgccaccctctcctgcgagggccagtcagagtgttaccacccngttagcctggtaccaacacaaactgccaggacctccacgcccctcatcttgactgccatccatcacgggtccacgtcggcactcccgagcctaggttcaggtcggcaggtcggtctgggaacagtcgttcactcgtacacctagtcacggccacgtacccgtagtacgacccgttaggaaacgttacgttttacggactttaagttttacgtaactcgttacaacgttacgtaccgttaacggtggtcgggtcccgtaccggggaccttaccggtttaccgggtacccgttacggggaaacctaagtttcggaacgtagaccgtaaataccgtggtcggtaccgtgaacctacctnttaccgttcttcttacgtccttccgtacccgtcacttacg

SEQ ID NO: 102786 - DNA, 752 bp, Homo sapiens
  misc_feature: GYAE6OF02HC80L.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccgaggggaaagacgccaccctctcctgcagggccagtcagagtcgttaccaccagttacgcctggtaccaacacaaacctggccacggctcccgacggcccctcacttctttgactgcactccatcgacgggcctacgtcggacctacgtccccgacgtcccgtaagggtttccaggttcggacgtaggggttcggggttaccgtagggggaactacggtaccgtttaccgaacccgttccgtaccctaaccgtacgttaccgaacgaccgtacgtacccgtaaggaacgtcccgtaagggtaacgtttaagttttttacggacgtttaaagttttaacgtttaacgttcgtaacctaaacgttacgtttacccgtaaccggtacggtccgggtcccgggtcccggggtccttaccggtttcccggccggttaccgggtaaccgtagggtacggaacgtaacgtaaccgaaacgtacgttagggtccggtacgtacgaccctaacgtacgttaccgtttcgttaccgtttactaccgtttaccccgttcccgtacctcgttaaccg

SEQ ID NO: 102787 - DNA, 676 bp, Homo sapiens
  misc_feature: GYAE6OF02HP53D.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagcccaccctgtctttgtctccgaggggaaagagccaccctctcctgcaggccagtcagtagtcgttaccaccctagttacgaccgtggtaacccaacacaaaacctcggaccaggtcctacccgacggcccctacgactcttgatcgcactcatcgaggccacgtgacactcccagaccgtagtcaggtcggcgtaggtgggtcgtggggtaacaggtaccttactactctaccaccatcagctacgacctagactcctagtaaattgtttagactttaagtttaacttacgtacggttaacaaacgttacgttacggtaaccgtcggttaccgggccgggttccccggggtaccttaccggtttcccgggacccgttacgggtaaaccctaaaggttcgaaaccgttagaaaccgtaaacgttacggtagtaccggtactacggacctaacgtaacgttcttacggttccttactaccgtttacccttccccgtacttagttacccgg

SEQ ID NO: 102788 - DNA, 708 bp, Homo sapiens
  misc_feature: GYAE6OF02JJWTA.8.19.B08.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccacccttgtctttgtctccgaggggaaancgccaccctctcctgaccgaggccagtcagacgtcgttaccaccagttacgccttggtaccaacacaaacctggaccacggcctacccagcccctnactcttgatgctactcatcgacggccagtcgcactcccgtagccgtacgttcgagtcggacacggtcgggtactgggaacncgtactcacgtctccactactcacgccgacgtccgtagaccgtacgtaccgttacgaagtttacgtacgttttacgtacttaaccgtttaaccgtttacctaacgttaacccgtaaacttacggtttaactttaacggttttaccctttttaccggtaccggttaaccgtttaccggttttacggggtacccgggggttaacctaacgggtaccgttaacgggtaacgttaacgtaaccgtaaacgttacggtaaggttccggtcgttaacgtccgtaaccttacgttacccgttacgttcttaccgttacggttacccttccctaccgtacg

SEQ ID NO: 102789 - DNA, 789 bp, Homo sapiens
  misc_feature: GYAE6OF02HL3S6.8.19.B08.1.454.CMB.1.raw
  modified_base (159)..(159): a, c, t, g, unknown or other
  misc_feature (159)..(159): n is a, c, g, or t
  modified_base (265)..(265): a, c, t, g, unknown or other
  misc_feature (265)..(265): n is a, c, g, or t
tcagctcgcgtgtccacgaccggtgctcgatttagtgagtcagtaagggggaggaactgctcagttaggacccagagggaaccatggaagcccagctcagcttctcttcctcctgctactctggcctccagataccaccggagagtatgtgttgacacngtctccagcccaccctgttctttgtcctacgtagggaaagacgccaccctcctcctgcgacgggccaggtcagagtcgttaccaccagttacgctacggtaccaanaccaaacgtcggaccacggcctacccgaccggccccgtctacgttctttacgattcggactacgtcctacgtcgacgggtaccctacgcgccttacgacccaacggtccgtacggttccgtaacggtcggacggttacgggtggggtaccggttggggaaaccgtaacgttccggttccaaccggttcctaacctaccgtactcgaacgtaccgacggtaccctaggtacgtaccgtaggaaacgttttggtttaccaagttttaacgtttacgttaccttacgttaactaaacgtacggtttaccggtaaccgtaggggtacccgggtttccccggacccgggggttacccttaccgggttttccccggaccggttacccgggaaacttaaacgttcggaaaccggttaacaaaccgtaaacgtaccgttcgggaacgttcgtccggtaaaccctaacggtacttacgttccgtttaccttcctaacccggttttccgtacccccgtaccgtagtttacccgg

SEQ ID NO: 102790 - DNA, 775 bp, Homo sapiens
  misc_feature: GYAE6OF02I53FI.8.19.B08.1.454.CMB.1.raw
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
tcagctcgcgtgtccacgaccggtgctcgatttagtgagtcagtaagggggggagaggagcccagcactagaagtcggcggtgttttccattcggtgatcagcactgaacacagaggactcaccatggagtttgggctgagcttgggtttttcctcgttgcttacttttaagaggtgtccagtgtcaagtgcaacgtggtggagttcggtgggggggcgtggtccgaggccgtgggacggtcccctggacgaccttccgttccgtggtgcgacgggcctacgtggtacttcctaacctttccgaaggttaacctaccgggcgttcgaccgtacgttcggggtcccnccgagggtcctaccgagggccgaaggggtcgttgggaggtcggngtcggtcgtagtttgttaccagttcgaagtaaagggtattcggttaacaacttactaataccgagtacccgtacggtaggaacggccgtaattcccaccgtactcctaccgagtaacaaccttaatacccgaaagaaccgaacgtaagtacgtacttcgagtaaccgtaaagcggtaaccgacgtaaccgtaaacgtaggtttacggaaggtacccgtacggttacgttttaacggtttttaacttaacggtttaaggaaccggggttaaaggggtacggggtaacttacggtaagggtacgggaccgtaacggttaaccgtaacccgttaaagtttaccggttaccgttttaaggaccccgttttgggaacccgggttaaccgg

SEQ ID NO: 102791 - DNA, 825 bp, Homo sapiens
  misc_feature: GYAE6OF02IT3TU.8.19.B08.1.454.CMB.1.raw
  modified_base (142)..(142): a, c, t, g, unknown or other
  misc_feature (142)..(142): n is a, c, g, or t
  modified_base (193)..(193): a, c, t, g, unknown or other
  misc_feature (193)..(193): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctgctccagataccaccgganagattgtgttgacacagtctccagccaccctgtcttgtctccaggggaaancgccaccctctcctgcgagggccagtcaggagtcgttaaccacctagttacgcctaggtaaccaaacaacaaaccgtggacctaaggcctaccccgaaggtccccctanacttaccgtttggaacttgaccataccaagtcgaacgggcctaccgnggctaactcccagacccgttaggttcacggttaggcaacgggttcggggtaccgtagggaaccaacggtaccttacggaaccttcctactaaccctaagtcaaacggcctaacggtaccttaagacgtacccgtaaggtaaacgttagttttaacggtacgttaaacgttttaacgttaccgtaagttaaccgaaacgttaaccgttaaccggttaaaccggtacgggttaccggggtaccccgggtaccgggggttacccttaacccggtttaccgggaccccgggtttaaaccgggtaaaccgtaaaaaaccggtttaggtaaacggttaaaccgttaaacccgtaaaaaccgtaacggttcgggttaacggtacccgtaccggttaaccaacccgtaacgtttaaccggtttacgttaccctttaaacgtaccttttaccccgggttaccctaacccgttacgttaacccggg

SEQ ID NO: 102792 - DNA, 703 bp, Homo sapiens
  misc_feature: GYAE6OF02F8MN4.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtgggtccaggccgtgggaggtccctgagacctctcctgtgcgaggctacgtggtacttcctacccttacgacgttaaccgtacggcgtgcacgtcgggtcccgccgaggcctccgaggacgaagggtcgttggaggtggcgtcggcgtagtttggtttcattcgtaggaaggtacgttagttacaacttactaatacgtacgtaaccgtacggtaggtaacgggccgtatttaccgaccctattccgtaccgtaacgacgtaaccttaacttacccgaaaacgaaacaaccgtaattacggtactacgttacgaactaaagtcgggaaccgtacgtaaccgtaaggtagttacgggaacggacgtaccggttacttacgttttaacgttaccgtaaggtaacgggaagggagggggtaactacggaaggttcggacgtcgtacgtaacgtacgttaccttacggttcgtacggtccggtacgggtaacccgg

SEQ ID NO: 102793 - DNA, 641 bp, Homo sapiens
  misc_feature: GYAE6OF02IFZY3.8.19.B08.1.454.CMB.1.raw
  modified_base (296)..(296): a, c, t, g, unknown or other
  misc_feature (296)..(296): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggtttttcctcgttgcttcttttaagaggtgtccagtgtcaagtgcaactggtggagtcgtggggggggctggtccagcctgggagtcctgagactctcctgtgcaggctctggacttcaccttcagtaactacggcgtgcacgtcgggtccncgaggcctcgaggctaagggcttagggagtggctggactagtttcgttcatctaggaaggtaagtgttacaagttactagtacaggtactaccggttggaaacgggtcccgtaattccgaacctagtcctaccgagacgaactaacttaccaagtaaacacgagtcgtatctagactaagtgacagacctaagacgttagagtacgacggtctttagttaacttacgtagtaacgggaaagggtacgggggtaattaacggaggtacggtacgtaacggtacctaccggtaaacgttaccgtttaaccgtttacggtaaccgtttaccggtcggggtaaccccgg

SEQ ID NO: 102794 - DNA, 813 bp, Homo sapiens
  misc_feature: GYAE6OF02F40CC.8.19.B08.1.454.CMB.1.raw
tcagctcgcgtgtccacgaccggtgctcgatttagtgagtcagtaaggggggaggaactgctcagttaggacccagagggaaccatggaagccccagctcagcttctcttcctcctgctactctggctccagataccaccggagagattgtgttgacacagtctccagccacctgtcttgtctccgaaggggaaagcgccaccctcgtcctgcgagggccagtcagtagtcgttaccacccgtagttacgcctcggtaccaaacaccaaaccgtggacccaggcctacccgacggtcccctctaacttcgtttacgacttcggacctaccttaccagtaccgaggggacccctaaccggttcgggacctaaccgtaccccgacggtaccgtaacgggttccgtaagggtcggtacgtacgggttcgggggtaccgtaggggggaaccctaacggtacccgttcgtaaccctaccgtttacccgaaccgtaacgtactacccgggacgaaccggtacccgtaaggtaccggtaacccgtaggtaaacgttacgttttacgacgtttaacgtttaacgttacgtacgtaccaacgttacggtttaccgtaccggtacgttccggggtacccggttacccgggggtacccttaccggtttacccgggtacccgttaccggggtaaaccttaaacggttacgtaaacgtaaccgaaccgtaaaacgtacgtacggtaccgtaccgttacgaccttaaccggtcttacgttagttaccgtttacctccgttacccgttacccggtacttacgtaaccg

SEQ ID NO: 102795 - DNA, 739 bp, Homo sapiens
  misc_feature: GYAE6OF02GSGZE.8.19.B08.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagatttgtgttgacacagtctccagccaccctgtctttgtctccgaaggggaangccaccctctcctgcgagggccagtcagagtcgttaccacctagttacgcctaggtaaccaacacaaaccgtggccaggcctcccgacggcccctnactcttgactgcactccatcgacggccacgtcggcactcccgagcctaggtcaggtcgcgtagggtcggtcgcggggaacagtacttcaccgttctacgaacctactaccgacgtcccaacgtaccgtaaggtaccggtaccgtacggtaagttacgttttacggtacgttaagtttttaactttacgttacgtaaccgtaaacgttaacgttaccggttaacccggtacgggttacccgggtccgggttaccccgggggtaccttaccgggttttcccgggacccgttaacggggtaaacccttaaaacgtttccggaacggttaacgtaaaccgtaaaccgtaacgttcggttaacggtccgtcggtaaccgttaccgtacgtttaccgttacgtttcccttaccttacccgttcccgtttaccccggacttacgttacccgg

SEQ ID NO: 102796 - DNA, 693 bp, Homo sapiens
  misc_feature: GYAE6OF02G8BH5.8.19.B08.1.454.CMB.1.raw
  modified_base (209)..(209): a, c, t, g, unknown or other
  misc_feature (209)..(209): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
tcagctcgcgtgtccacgaccggtgctcgatttagtgagtcagtaagggggaggaacgtgctcagttaggaccagagggaacatggaagccccagctcagcttctcttcctcctgctactctggctcccagataccaccggtagagattgtgttgacacagtctcacgccaccctgtctttcgctaccgaggggaaacacgccaccctntccgtgacgacgggaccagtcagtacgttcgttacccactgttacnccgtaggtaaccaacactaaaccgtggccaacggtcctcccgacgtcccctntacgtttcttcgangcctactccaancgtacgggccacgtgccaactccgacaccgttgtccagcggactagggtcgtacgtagggacctaggaacctttccaactctaccgtaacacgtcaagtccgaactcccggtagacgtcgtacgaacgttactttacgtacgttaacgtttcttaaacgtcgttaacctaacgttacgtaaccggttaccggtacgggtccggtaccggtccggggtaccctaccggtttacccggtaccggtccgggttaaactaaccggtagtacaacgtaacgtaaacgtacgaggtcgtacgtcgaaccgaccgttaacgttcttaccgttacttctacctttaccggtccctaccgtcgtaaccg

SEQ ID NO: 102797 - DNA, 818 bp, Homo sapiens
  misc_feature: GYAE6OF02GA0TP.8.19.B08.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
tcagctcgcgtgtccacgaccggtgctcgatttagtgagtcagtaaggggaggtaacgtgctcagttaggacccagagggaaccatggaagccccagcgtccagcttctcttcctccgtgctactctggctcccagtttcagataccaccggagagattgtgttgacgacaatcctccagcccacctgtccttcgtcctccgagggaaacgacgccgaccctcgtcctgcgaggccagtcagatgtcggcnctagntccgtgtaccagagaaccngacaggcctccgacggcccctanactcctagtcggtncgactccgaacgacgggtcccaacgttggacctaacgtcccgacgaccgtacggttaccgtagggtacggtacgtaggttacggggttaaggtacggggtaaccgttaacggggttaaccctttaccggtaaacccgtttccgtaaccccgtaacccttaacgttaaccctaacgttttacccgaaccgggttacccggttacgggtaacccgtacccgtaggggttaaacggtaagtttcggtttacggaaccgtttaacggtttttaacttaccgttacggtaaccttaaacgttaaccgttacggttaaacccgtgggttacccgggtttaccccgggacccgggggttaaccccgtttaccgggtttaccccgggacccggtttaacgtaaaacccggtaaaggttacgtaaccgttagtaacccgtaaacgtacgtcggtaacgtcgtacgacccgtacgtacttaccggttccgttcctacctacgttcccgttaccccg

SEQ ID NO: 102798 - DNA, 749 bp, Homo sapiens
  misc_feature: GYAE6OF02HLDM1.8.19.B08.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacagtctccagccaccctgttcctttgtcctccgaggggaaanacgccctaccctctcctgcgacgggccagtcaggagttcgttaccaccctagttacgccgtaggtaaccaacaacctaaaccgtgcccgaggcctcccgacggcccctcactcgtttagatcgacactccaatccggacgggaccctacgtcgggacctaccgtaccccgacgtcccgtacgggttacacggttcggacgtaagggttcggggtccgtagggggactacgtaccgtttaccgaaccttccgtaccaacccgtataccgtaagccgacgtacctacggacgtacctaagtaacgtttagtttacgtacgtttaagttttaacttaccgttacgtacgtaacttaacgttaccggtaccggtacgggttccgggtcccggtacccggggtcccttaaccggtttcccggtacccggtaacggaaaccgttaaacgttacgaacggtacgtaaaccgtaaaccgtagtacggtcgtacgtcgaccgtaacctacgttcgttcgttacgttcttaccttcccgttacccgtcttaccgtaccgg

SEQ ID NO: 102799 - DNA, 966 bp, Homo sapiens
  misc_feature: GYAE6OF02HYLT0.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggcctacccagataccaccggagagattgtgttgacacacgtcctccacgcccacccgttgttacctttgtacctaccggaaagggggtaaagtacgccccgtaacccttccgttccctacggccggacgggaccctaaggttaccgaaggtaacggtttaccgttaccccgaaaccccgttaaggtttaccggaccgttacggtaaaccccaaaccgtaaacccctaaaccggttccggacccgtaacgggtcccctaaccccggacccgggtcccccttactacgtttaccgttacgacgttcgtacctaacgtaccctaacgtccggaaccggggtacccctaacggtccggtaacccacccgttaccccggaacggtaccccggttaagggtttaccctaacgggggttccggaccggttacggggttcggggttaaacccggtacggggtaaacccttaggttaaccccgtttcctaaaccgttacccgttaccaacgtaacgttaccacggtacccgtaaacgttaccccgtaaaggaccgtaccggtaaggttaacgtttagttttaaccgtacgtttaaacgttttactaacgttacgtaaaccgttaacctaacggtacccgggtacgtaaccgggttcccgggacccgggttcccggggttacccttaccggttacccgggtaacccggtaacggttaaaccggtaaacgttaccggttaagtaaacctaaccgtaaacggtaccgtacggttaccgtaccgtggaacccttacgtaacgttcgttacgttacccttaccttccgttaccccgtacctaccgttataacccgg

SEQ ID NO: 102800 - DNA, 876 bp, Homo sapiens
  misc_feature: GYAE6OF02H1H7P.8.19.B08.1.454.CMB.1.raw
  modified_base (172)..(172): a, c, t, g, unknown or other
  misc_feature (172)..(172): n is a, c, g, or t
  modified_base (186)..(186): a, c, t, g, unknown or other
  misc_feature (186)..(186): n is a, c, g, or t
tcagctcgcgtgtccacgaccggtgctcgatttagtgagtcagtaaggggggagaggacgccagcactagaagtcggcggtgtttccattcggtgatcacgcactgaacacagaggactcaccatggagttgggctgacgcttgggttttcctcgttgctctttaagaggtntccagtgtcaagtncaacgtggtggagtcggtgggggggctggtccagccgtgggacgtcctgacgactctctgtcgacagtctgtaggacttccaaccgttcaagttaaccgtacggcgttcgcgtaacgttcggggtcccgaccgtagggtaccctcccgaaggtccggtaaaacggggtccgttaggggtaaccggtgggtaccgtcgggttacgtacggtttttcgtttaccgtacgtccggtaagggtaaacgggtaacgtttcggtttaacctaaagtttaaccgtaagtaaccgtaaacggtaacgttaccccggggtaaggtaaacccggggtacccgtaacttttacccgaaccgtaaccttaccgtaacccgaaggtacgtaaacccgttaaccgttaaaccgaaacggaaaccctacggtaactttaaccgggtacttacgtaggtaaacgtaaacgtcggaaacccgtacgaaaccggtttaagaacgggtttaacggaaccggtaccgggtaaaccgtttcgtttaaacgttttacgtaaacggttacgggttaaaacgggtaacggggttaacggggactaacgggttaaccgggtaaggtacccgtaaccgtaccggttaaactaccggtttaaccctttaaacgtttacccggtaaccgggtttacgggacccgggttaaaccccggg

SEQ ID NO: 102801 - DNA, 778 bp, Homo sapiens
  misc_feature: GYAE6OF02IVXQ4.8.19.B08.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (528)..(528): a, c, t, g, unknown or other
  misc_feature (528)..(528): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacagtctccagccctaccctgttctttgtcctccgaaggggaaancgccctaccctctcctgcgacgggccagtcagtgtcttaacccacctagttacgcctacggtaaccaacaccaaccgtgaccgacggcctacccgacgcccctnacttcgtttgactcgactacgtacctagtaccggacgggaccctacgtcggaccctaaccgccccgtaggtaccccgttaagggttcaacgggtcggtacctagggttacggggccgtacggggaacctacgggttaccttaccgaccttcgtaaccctaaccgtatacccgaacgaccggtacgtaccgtacggacgtacgtaacggtaagtttacgtttanacgtttaacgtttacttaccgtagtacctaacttacgttacgtacgtacggtccggtaccggtcccgggttaccgttaccggttccggtaccccgtaacgggtaaaccttaacggtacgtaaccggtaacgttaaccgtaaaacgttccgtacggtaccggttaccgtaccgtaaccttaaccggtacttaccgttccgttaccttacccgttaccgttacccgttccccgttaccgttaccttaccggg

SEQ ID NO: 102802 - DNA, 740 bp, Homo sapiens
  misc_feature: GYAE6OF02JIYYW.8.19.B08.1.454.CMB.1.raw
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcacgggccagtcagagtgttaccaccagttagcctggtaccaacacaaaacctggaccaggcctacccacggccccctacacttcctttcgacttcgctactccatacgacgggccacgtggacactcccagcctaggttcgagtgggctaggtcgggtctagggacacgtaccttcactcctcacctactcaacgtcgaacgtccctaacggacgtcccgtaggtaaacgttgttttaacggacttaagtttttaacgtaaccgtttacgtaacctaaacgttacgttacccggttaacccggtaacggttcggggtacccggttacccggggggtacccttaaccggtttcccgggaccccgttaacgggggaaacccttaaaaacggttttccgtaaacgttaaaccgtaaccgtaaaacgttaaccgttacggttacggtaccgttacggaacccgtacgtaacgttaccgttacggttacctttacgtaaccgttaccctttccccggaccttacgttaacccg

SEQ ID NO: 102803 - DNA, 906 bp, Homo sapiens
  misc_feature: GYAE6OF02F0ZIM.8.19.B08.1.454.CMB.1.raw
tcagctcgcgtgtccacgaccggtgctcgatttagtgagtcagtaagggggaggaactgctcagttaggacccagagggaacatggaacgccccagcctcagtccttctcttcctcctgcctactctggcctccagactacccacggagagattgtgttgactacgagtctccacgccctacccttgttctttagtcctaccggaagggggaaagtccgccctacccctccgtccgtcggaccgacgggacctagttccgaggtacgttaccggtttaaccccaaccgtacggttacgtcccgttaaccgggtaaacccaaaaccctaaacccgtaaaaccggttccgggaccccgtacgggtaccccgtaccccgtaaccgggtccccccttacgttaaaccgtttccgttttccggaattcggacccttaacttaaccccccgtaagtacccggaaaccggggtacccctttacgggtacccggaccttaacccccgtacccgttaccggacccgggttaaacgggttccgtaacgggttacgggtcggttagggggttcccgggtttaaggtaccgggtaaaccggtaccggtttacccgtaactaccccggttaccctaccctaacgtaacctcggaacgtacccgtaacgtaacctccgggtaacgttaccgtagtaacgtttcttaagtcctttaagtttcttaacgtacttaacgaacgttctacggttacgtaccgggtcccgtcccgggtaccggtaccgttaccgttcccgaacggttacggtaacgttaacgtcggtaaactacggttaaacccaggtacctagggttcgtccgacgtaccgtacttactccgacgtttactccgttaccgttcccgttaacccgttactaccgg

SEQ ID NO: 102804 - DNA, 577 bp, Homo sapiens
  misc_feature: GYAE6OF02IIF3H.8.19.B08.1.454.CMB.1.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (275)..(276): a, c, t, g, unknown or other
  misc_feature (275)..(276): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
  modified_base (570)..(570): a, c, t, g, unknown or other
  misc_feature (570)..(570): n is a, c, g, or t
tcagctcgcgtgtccacgaccggtgctcgatttagtgagtcagtaaggggggaggaactgctcagttaggacccagagggaaccatggaagccccagctcagcttctcttcctcctgctactctggctcccagataccaccggagagattgtgttgacanagtctccagccaccctgtctttgtctccaggggaanagccaccctctcctgcagggccagtcagagtgttaccaccagttcgcctggtaaccanacaaactgcagctccagcccnntctgntgcntcatcgaggcacgtgcactccagcagtcagtcgcagtggcgtgggacngacttcgactctacacgtactanacgcagtcctaagacgtcctaggaagttattttacgcttaagttttacgtacttacgttacaactaagttaccggtacgtaggcggtccgcccggggtctaccggtttccggacccgtacggggaaacctaaagtcgtaacgaagtaaccgaaacgtacgtacggtgtacgtcgacctaaccgtnttacgtnttaccgttcaccttccgtcccncacttcg

SEQ ID NO: 102805 - DNA, 742 bp, Homo sapiens
  misc_feature: GYAE6OF02HNS2T.8.19.B08.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (351)..(351): a, c, t, g, unknown or other
  misc_feature (351)..(351): n is a, c, g, or t
tcagctcgcgtgtccacgaccggtgctcgatttagtgagtcagtaaggggggaggaactgctcagttaggacccagagggaaccatggaagccccagctcagcttctcttcctcctgctactctggcctcccagataccaccggganagtattgtgttgacacagtctccagccacccttgtctttgctcaaggggaangccaccctctctgcagggccagtcagtntcgtaccacctagttcgcctaggaccaacaccaaactggaccagctacccgaggcccctcactctttgactgctactccagtccgaggcccagtcggaccacctcccgacgtccgtacggtttnacggtcggtacgtacggggttggttaccggagggggtaacctacgggttacccttcgtaacccgttcctaaccgaccttgtaccaggccaacgggtacccgttaacggcggtaccgtagtaaacggtttacgtttacggtactttaaggttttacttccgttagtacctaaacgttcgtaccgttacggtacggttacggacccggttccggggtacccttacgtttacccggggccgttaacgggtaaccttaaaggttcgtaacggtaactaaccgggtaaactacggtacggtttacggacggtaccgtaccgttaaccgttccgttaccggttacgttcccgttacgttaccccgtttccccgtttaccggtccttaaccggtaccg

SEQ ID NO: 102806 - DNA, 957 bp, Homo sapiens
  misc_feature: GYAE6OF02J0DSL.8.19.B08.1.454.CMB.1.raw
  modified_base (223)..(223): a, c, t, g, unknown or other
  misc_feature (223)..(223): n is a, c, g, or t
  modified_base (383)..(383): a, c, t, g, unknown or other
  misc_feature (383)..(383): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctcggctccctagtttcagtactaccgaccggagagattgttgttgacactacgtctccacgccctacccgttgttcctttgtcctaccggaaggggaaacnccgtaccctaccccttcgtccctcggacccgacgggtccgtacgtctaaggtacttggttacggtcccggttaccgtttaccggtaacgtccggtttacggtaacccgaaccaacctaaaccgtccggaccgacggtccctaccccgacggtcccccgtntaacttcgtacgtggttccgacgttaccgaacccgtacgaccggacctacggtccggctacccgtacccgacgtcggttacgttccggtacgggtacgtacggaaggttttcggggggtaaacttcggggggaacctacggtaacccggtttccaaccgttaccctaccgaaacccctagtttccgaatttacccgggtacggaccccgtttacggggaacttacccccggtttaagtaaacgggttacgtttacgggtttaaccggttactttaaacggggtttttaccctttaaacggtttcgggtaaccctaaacgttaccggttacccggtttaaacccgggcggtttacccggggtcccggttttaacccccggggggttacccgttaacccggttttaccggggtccccccgtttaaagggggtacccctaaaacgggggtttaccgggaacccgggttaagttaacccgttaacccgggtacggtttaaccggccggttaccgtacggtacccttaccgtacgttacccgtcggtttaactcccgtttaccgtcccgtttaccccgg

SEQ ID NO: 102807 - DNA, 818 bp, Homo sapiens
  misc_feature: GYAE6OF02JQS8P.8.19.B08.1.454.CMB.1.raw
  modified_base (452)..(452): a, c, t, g, unknown or other
  misc_feature (452)..(452): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtcctccgagggaaacgagccacctctcctgacacgggccagtcacgacgttcgttacccaccgtagttacgacctggtaacccaacacaaaccgtcggaccacggtcctacccgacggtccccctactacttacgtttcgacttcgcctaactccaagttcgacgggcctacgtcggaccactcccagcctaagggttcacggtgaccgtggtacgggtcgtagggtaccaacggtacttaccggaacttccctacctaaccgtttaacnccggaacggtcccgtaacgtacccggtagaaccgttccgttaacggtaacgtttaccgttttacggtacccttaaggttttaactttaccgttcgttaacctaacgttacgtttaccggttaacccgggtaacggtccgggtcccggtaccccggggtaccttacccgggtttacccggggtccccgttaacccgggaaacctttaaaacggttacgtaaaccggttacctaacccggttaaagtacccggtttaccggttacgggtaccttccggggtaaccctaaccggtaaccttaccgtttaccggtaccgtttacgtaaccccggtttaacccgtccccgttaccgttaccgttaacccgg

SEQ ID NO: 102808 - DNA, 675 bp, Homo sapiens
  misc_feature: GYAE6OF02G847E.8.19.B08.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtgagtcagtaaggggggaggaactgctcagttaggacccagagggaaccatggaagccccagctcagcttctcttcctcctgctactctggctcccagataccaccggagagattgtgttgacacagtctccagcccacctgtctttcgtctccgaggggaaangccaccctctcctgcgacgggccagtcagagttcgttacccaccctagttacgccgtacggtaacccaacacgaacctggacccaggcctcccgacggcccctactacttcttagactcgcaactccagttccgacgggtccacgtcggaccactcccagccgttacgtcgaggtcgcgtaggtggtcgtagggactagtccgttacactcaccactactcgacgcacgtactaggtactccgtagtaacgttctttagacctttagtttactacgttactacgtaactacgttaccgtacgtcggttcggacccggtccgggtaccttaccgtttccgggacccgttaacgggtaaccttaaacggttcgaaacgtacgttaaaccgaacgttacgttcggacgttcgacggtacctaccgttacttcgttacgttaccgttcttaccgttcccgttaccctacgtacttaccgg

SEQ ID NO: 102809 - DNA, 723 bp, Homo sapiens
  misc_feature: GYAE6OF02F1T52.8.19.B08.1.454.CMB.1.raw
  modified_base (199)..(199): a, c, t, g, unknown or other
  misc_feature (199)..(199): n is a, c, g, or t
tcagctcgcgtgtccacgaccggtgctcgatttagtgagtcagtaagggggaggaactgctcagttaggacccagagggaaccatggaagccccgagctcagcttctcttcctcctgctactctggctcccagataccaccggagagattgtgttgacacagtctccagccacccgtgtctttgctccgaggggaaagngccacccgtctcctgcgaggccagcttagagtcgttaccacccagttagcctaggtaaccaaccaaccaaacctggacccaggcctacccgacggcccctcactctacgtggtcgcactccaacgacgggccacgtcggcctatcccaagccgaggttcaagggttcggacgtagggttcgggtagtacggggaactaacggtacttacctaccgtcctaaccaacctaacgtcctaacgttaccgacgacccgttaagggaccgtcctaagggaaacgttacgttaggttcgtacgttaaggttttaacttacgttacgtaacctaacgtacgtaccggttaacggtacgggtccggttcccggtcccgggggtaccgtaccgggttcccgggtaccgggtaacggggaaccggtaacggggtacggaacggtaacgtaaccgaaaccgggtactaggtacggcgtagcccgtactacgttcgtacgttccttaccgttccgtcccgtactacgtcggtaacg

SEQ ID NO: 102810 - DNA, 644 bp, Homo sapiens
  misc_feature: GYAE6OF02IH2D3.8.19.B08.1.454.CMB.1.raw
  modified_base (506)..(506): a, c, t, g, unknown or other
  misc_feature (506)..(506): n is a, c, g, or t
  modified_base (541)..(541): a, c, t, g, unknown or other
  misc_feature (541)..(541): n is a, c, g, or t
  modified_base (579)..(579): a, c, t, g, unknown or other
  misc_feature (579)..(579): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagcttgggttttcctgttgcttcgttttaagaggtgtccagtgtcaagtgactaacgtggtggagtcggtgggggggggctcggtccaggccgtgggacgtccgtgacgtacctctccgtggtgcgaggcctgtggtacttctacctttcgaagtaaacgtcggcgtgactacggtcgggtccgccgacggcctaccgaggtaccggaagggtcgttgggaagttcggcttacgggacttggtttgtttacctattcgtaaaggacgttaaggttgtacctaagtctaagtacgagtacgtcgtagtaacggtctaactcctacatcctacgtagagaactaactacgaagtaacagtatcgtaactnactagaatcgaacacgactagagtggaacgtacgnggtacttgttactacgtaacgttaagggaggtagggtntacgacggtcgtaaccggttaccgacgttacgacttaccgttaccgtaggtccgtagggacccgg

SEQ ID NO: 102811 - DNA, 834 bp, Homo sapiens
  misc_feature: GYAE6OF02HJ5LS.8.19.B08.1.454.CMB.1.raw
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagcttgggttttcctcgttgctcgtttttaagaggtgtccagtgtcaagtgcaacgtggtggagtcggtggggggggctggtccagccgtggacgtccctgacgactcctccgtgtgcgaggcctcgtcggtacttccctaccttccgaagttaaaccgtacgggtccgtacgtccgtaacgttggggcccaccgacggtcccgtaccgagggaccgaacggggttctttagggtacggttgggtaccccgttggggtaccctttagggttttacgttttaccgtaacgttccgttaaagggaaacgggtttaacggtacgttttaaccgtaaaatttaacccgttaaagttaaacccgtaaggttaacccgttacccggggtaaagggttaaaccggacccggttaactttacccgaaccgttacccgtaccgttaacccaaggtaaccccgtaacgtaaaacccgttacgtaaaaccgaaaccgaacggttaataacgggtactaccggttaagtaccgtaaaacgtcgtaaacgacgtaacccgttaaagcgggtttaagacggtaccgtacggttaccgttagttttaacgtaccgttaagggtaacgaaggggtacgggtacgtacggtaggacggtaccgtacgtacctacgttagtacttcgttacgttcgttacggtacggtaaccgg

SEQ ID NO: 102812 - DNA, 591 bp, Homo sapiens
  misc_feature: GYAE6OF02GAB50.8.19.B08.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaanagcccaccctctcctgcagggccagtcagngtgttacccaccagttagcctggtaccaacacaaaccgtggccaggctcccaggcccctcatcttgatgctatcatcagggccacgtggcatcccgagccaggttccaggtcggctagggtgggtgttggggacaggactttcaacgtctacaccgtatcaggcagcctagagccctagaagtatttagcttagtttaacttacgtcgtactaactagttacgtaccgtagtcggtccgtccggggtccgtacgttccggtccgtacggtaaccgtaaagtcggaacttagtaaccgtaaacgaccgttagtcggacgtcggacacgtatacgttcgttcttcgtacgtcctacccgtctactcg

SEQ ID NO: 102813 - DNA, 833 bp, Homo sapiens
  misc_feature: GYAE6OF02HVNQW.8.19.B08.1.454.CMB.1.raw
tcagctcgcgtgtccacgaccggtgctcgattttagtgagtcagtaaggggggaggaactgctcagttaggacccagagggaaccatggaagccccagctcagcttctcttcctcctgctactctggctccagagatcagttggagaaggtggtgatgacactacgtcgtccggtcacccttgtccttggtttttaccgtggggacgagacgcctacccttcgtcgtgtcgccggtcctagtaccagtacggtacggttacggtaacgtaaccgttacggtccgttaggttactacgacggtacctacggtaccggaccgtcggaccggtaccggtacccgtacccgacgtacccttacccgtacgttaccggtttccggttacggtaccccgtttaacccgtttaaaccggaccgggtaccggttaacggtaaccggtaccgtacccggtaccgtaccggttacggttaccggacggtccggtacggtcgggttcggggttaccggttacgggttaccgtttccgttaccgtccttacccgtacctaacgtacctaacgtaaccgttacgaccgtaactaccgtcgttaccgtacgtttacgtttacgttacgtttacgtttagttcgttacgtacgtacgtagttacgttacgtacgtacgttaccgttacggttccgttaccgttaccggtacgggtaccgggtaaccggtaaccgtaccgggtaccgtacctaaacgggaccgtagtcgttcgacgttacgaccgtaacgtcgttcgtacgttacctaccgttaccttaccctacccgtatacctcggtaccgtaaccg

SEQ ID NO: 102814 - DNA, 847 bp, Homo sapiens
  misc_feature: GYAE6OF02JWIB5.8.19.B08.1.454.CMB.1.raw
  modified_base (147)..(147): a, c, t, g, unknown or other
  misc_feature (147)..(147): n is a, c, g, or t
  modified_base (215)..(215): a, c, t, g, unknown or other
  misc_feature (215)..(215): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggcctcccagactaccaccggagngattgtgttgacacgagtcctccagccctacccttgttcctttcgtacctaccggaaaggggaaaacnccctacccttcctaccgttgaccggaacggggtaccctaggtacgagtacggttccgtttaacccaacccgttaggttaaccgcccgttaaccgggtaaaccccaaaccgaaccgtaaaaccgttcggaccccgtaacgggtccccttaccccgaccggtacccccttacgtactttaccgtttaggaccgtcggtacctacgtaccctaacggttcccgaaccggggtaccccttaacggtccggaccttaacccgtccccgaagtcccgtacggtttacgagtaccgggtccgtgggttcgggtacgtacggactacgttacctacctaccgtctaccgacttacgacgtaaccgtcgaccgtccgacgtacgtaccgtaagtacggttatttaacggctttaagttacctagtacgttaacctaagtaccggttaccgtacgtacgggtacccgtacccgggtaccgggttaccttaccggggtttacccgacggttaaccggtaaaccgttaaagtcggaaccttaacggtaccggtaaactacggttaggtcctagtcccggtacttacgtacgttcctcttaccggtacttacccgcccgttaccggccctaacggtccgtaacgg

SEQ ID NO: 102815 - DNA, 676 bp, Homo sapiens
  misc_feature: GYAE6OF02GU0MJ.8.19.B08.1.454.CMB.1.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (328)..(328): a, c, t, g, unknown or other
  misc_feature (328)..(328): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattggtgttgacacagtctccagccacctgttctttgctcgagggaancgccacctctctgcgacggccagtcagagtcgtaccacctagttacgcctgtaaccaacacaaccgtgacacgcctcccgacggtcccntacttccgttagagtcgctactccacgtcgacggccacgtcggacncgtacccgagccgtaggttcacggtacggacgtagggtcggttcggacggggtaacacggttaaccttcgaaccttccgtaccacctactacggacgtaaccgcgtacccggtagtaaccggtacctaaggtaagtttctttggtaacctttacgttttaacgttaccgtaatacctaaagttacgtcccggtacgtaccgggtacggtcccggtaccgggtacctttccggtacccggtacgtacgtaaccttaagtcgaacgtactaacgaagtacgtaggtctacgtcgacctacgttagtccgttagttacctacgtcctttacccggtcctacgtagtacccg

SEQ ID NO: 102816 - DNA, 710 bp, Homo sapiens
  misc_feature: GYAE6OF02HG1MI.8.19.B08.1.454.CMB.1.raw
  modified_base (193)..(193): a, c, t, g, unknown or other
  misc_feature (193)..(193): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggagagattgtgttgacacagtctccagccacctgtctttgtctcgaggggaancgccaccctctcctgcacgggccagtcagagttcgttaccaccagttacgcctaggtaccaaacaccgtaaaccgtcggacacggccctacccgaccggcccctactacttcgtttagactgcctactccattccgacggggtccaacgtggacctaccgtaccccgacgtacctacgggtttcgacggttacgggtcgtaaggggttcggggtcggtacggggaacctacggttaccgttacgtacccttccgtacctaaccctagttacccgaacggtcctaacgggtacccttaacgggaccgtcccgtaaggttaaacgtttgtttacgacggttttaagtttaacttacgttacggtactaacgttaactcggtaactacgggtcgtacccggtccgggtaccttacggttcccgaccgttacgggtaaactagttgaacgtactaacgtaacgctgggacgacgtcgacctacgtctcgttacttctcgtactccctacggcctactaccg

SEQ ID NO: 102817 - DNA, 721 bp, Homo sapiens
  misc_feature: GYAE6OF02JO0DS.8.19.B08.1.454.CMB.1.raw
  modified_base (135)..(135): a, c, t, g, unknown or other
  misc_feature (135)..(135): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagctcgcgtgtccacgaccggtgctcgatttagtgagtcagtaagggggagggaactgctcagttaggacccagagggaaccatggaagccccagctcagcttctcttcctcctgctactctggctcccaganaccgacggagagtattgtgtttacacagtctcgacnccacctgtcttgtctcgagggaanacnccacctntccngnacggcagtcagattgtgctctcgagctgaccaacactaacnaccagccnccacgccctnactntagngtcncacacacgcggtacncgtacgctactaccacgctacgtacgtggacgtanagggtacggtaggngtaacgtcgtacttacgactcccacgtaccatcaacgttcacggtcctaggacgtcggagtaacgttgtaacgttcgtagttactttacgttacgttacgaacgtttacgaaccgttaccggtaaccggttagttacccggggtcccggggtccgggttacccggtttaccggttccccgggtaccggtacggttaacccgggtaaggggtttaacccggtaacgtacccggtttaaaaccgaaaccgttacgggttacgaaaccgggtttccgtaacccgggtaaccgttaacccgtccgggtttttcgaacccggttttaccctaccggttccccgtttaacccggtttcccccgacgtttaacgttcccggg

SEQ ID NO: 102818 - DNA, 864 bp, Homo sapiens
  misc_feature: GYAE6OF02F1NY8.8.19.B08.1.454.CMB.1.raw
  modified_base (142)..(142): a, c, t, g, unknown or other
  misc_feature (142)..(142): n is a, c, g, or t
  modified_base (152)..(152): a, c, t, g, unknown or other
  misc_feature (152)..(152): n is a, c, g, or t
  modified_base (198)..(198): a, c, t, g, unknown or other
  misc_feature (198)..(198): n is a, c, g, or t
tcagctcgcgtgtccacgaccggtgctcgatttagtgagtcagtaagggggaggaactgctcagttaggacccagagggaaccatggaagccccagctcagcttctcttcctcctgctactctggctcccagataccacggngagactttgngttgacacagtctccacgccaccctgtctttgctaccgaggggaancgccaccctctccgtgacgagggcctaggtcaagagttccgttaacccacccgtaggtttacgccttacggtaacccaaccgaaacaaacccggtggaccctaacgggcccttacccccggacggtccccctacgtaacgtttccgtttagacttcggtactacttacccaagttccggaacgggcctaccgggtcggacctacccgtacccgtacggacccgttaacggggtttccgaggggtttaccgggcgttacgggggtttacgggggtccgttaacgggggaaccttaagggttacccttttaccggaacccttttccgtacctaaaccgtactaaccggacgtaccgttacggtacccgttaagaccgtttaccgtacggttaacgttttacgttttacggttactttaaggttttaccttacggtactaaccgtaacttacgttacggttaccggtacggtccgggttccccggttaccgggggtacccgtttaccggtttcccgggtacccggttacggtaaaccgtaaggtttacgaacgttaacgtaaccgaaacggttacgtacggttcggtaccgtccgtaaccggtaacctacgttaccgttccgtttaccggttcctacccggtttcccgttaccccgtacttactaccgg

SEQ ID NO: 102819 - DNA, 911 bp, Homo sapiens
  misc_feature: GYAE6OF02H0G19.8.19.B08.1.454.CMB.1.raw
tcagctcgcgtgtccacgaccggtgctcgatttagtgagtcagtaagggggagaactgctcagttaggacccagagggaaccatggaagccccagctcagcttctccttcctcctgctactctggctccagtataccgaccggagagtagtttcgtggttagacacacgccctccgacgccccaccgttggttctttacgtcctaccggaaggggaaagacgcccacccttctccgtcggacgtacgggacctacgtacgaaggtacggttaccgttaacccacccgtaaggtttccggccgttaacgggtaaccccaaaacctaaaccgtaaacccggtcgggtaacccgtaaccggggtacccctaaccccggaccccgggtacccccttaactaccggtttccgtttaaggaacgttcggaccttaaccgtccaacggttaccggaaccggggtaccctaacggttccgggacctaaccgccccgtaacgggtaccggttacggttaccggtacgggtacggacggtacgggttcggggttacgacggggtaactacgttaacccgttccgacccgttacaacccgtactactaccggaagtaccgtaccgtacgtacggaaccgtaccgtaagtaacggtttacgtttacgtgtttaaacgttttacgtacgtacgtaccctaaacgttacccggtaggttaacccggtgggttacccggggtcccggtaacccggggttactttaccccgggtacggtaaccccgtttaaagaaaccgtttaacggtcggtaaccgtaactaaaccggtaacgtacgttcggttaccgtacgacgttaacctacggtacgtttaacttaccggtttacgtccgtacccgtttacccgtaccctggttaacgtacgg

SEQ ID NO: 102820 - DNA, 488 bp, Homo sapiens
  misc_feature: GYAE6OF01BKH9X.3.34.D01.1.454.CMB.1.raw
  modified_base (452)..(452): a, c, t, g, unknown or other
  misc_feature (452)..(452): n is a, c, g, or t
tcagagacgcactccacgaccggtgctcgatttagatcgtctgtgttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtcaaatagcagacagcaatggaaccatagggctgtggtgttcggnggagggccaagctagaccgtcaagtcagcccaacgg

SEQ ID NO: 102821 - DNA, 309 bp, Homo sapiens
  misc_feature: GYAE6OF01B5NFN.3.34.D01.1.454.CMB.1.raw
  modified_base (305)..(309): a, c, t, g, unknown or other
  misc_feature (305)..(309): n is a, c, g, or t
tcagagacgcactccacgaccggtgctcgatttagatcgtctgtgttgggtttggggtgaggtctgtgtcactgtggtattactatggttcgggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaggactacttccgagtgcgtctctgagcgggctggcaaggcgcatagnnnnn

SEQ ID NO: 102822 - DNA, 309 bp, Homo sapiens
  misc_feature: GYAE6OF01DMBGK.3.34.D01.1.454.CMB.1.raw
  modified_base (306)..(309): a, c, t, g, unknown or other
  misc_feature (306)..(309): n is a, c, g, or t
tcagagacgcactccacgaccggtgctcgatttagatcgtctgtgttgggtttggggtgaggtctgtgtcactgtggtattactatggttcgggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 102823 - DNA, 312 bp, Homo sapiens
  misc_feature: GYAE6OF01DL0HB.3.34.D01.1.454.CMB.1.raw
  modified_base (306)..(312): a, c, t, g, unknown or other
  misc_feature (306)..(312): n is a, c, g, or t
tcagagacgcactccacgaccggtgctcgatttagatcgtctgtgttgggtttggggtgaggtctgtgtcactgtggtattactatggttcgggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnn

SEQ ID NO: 102824 - DNA, 515 bp, Homo sapiens
  misc_feature: GYAE6OF01EF61F.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggactcccgtgacgcgaatctctggctccagctcgagggacaacagtcacgttcgaccatcgagtggacgtccgaggcaaggaagacgaggctgactatcactgtacaaatgacaagacagacaagtacggaacccagtaggctggtggtggttcggagggaggaccaggctacggaccgtctaagcacgcccgaacgg

SEQ ID NO: 102825 - DNA, 550 bp, Homo sapiens
  misc_feature: GYAE6OF01CWYKI.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggatccccgtgagcgaatctctggctccagctcagggacaacagtcacgttgaccatcagtggatcaggcaagaagacgagctgacatcactgtacaaagtagacaagaacgagacaaagttacggaacccaagtacgggactgggtagggttacggttcgggacgggaacggggtaccgaaaggtccgtaggtaaccccggttcgtaagggttccaacggtccccgtaaacggg

SEQ ID NO: 102826 - DNA, 549 bp, Homo sapiens
  misc_feature: GYAE6OF01BMKXF.3.34.D01.1.454.CMB.1.raw
  modified_base (291)..(291): a, c, t, g, unknown or other
  misc_feature (291)..(291): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggacaaagctatatgcttactggtacagcagaagccagccaggcccctgtggtgtgatataanaaagacgtgagaggccctcgagggactccctgacgcgaatctctggcctccacgctcgacgggacaacacgtcagttcgaccatcgagtggacgtcaggacaaggaagacggagcgtagaactatcactgtacaaatagcaagacgagacaaagtacggaacccagttacgggcttggtagggtcgttcgggaggtaacgggaccaaggcgtacggtaacccggttaccgtaaaggtcctacggacccgtaaaccggg

SEQ ID NO: 102827 - DNA, 525 bp, Homo sapiens
  misc_feature: GYAE6OF01C9KNU.3.34.D01.1.454.CMB.1.raw
  modified_base (410)..(410): a, c, t, g, unknown or other
  misc_feature (410)..(410): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtacagcagaagccaggccacggcccctgtggtggtgatataataaagaccgtgagaggccctgagggatccctgagcgaatctcgtggctccagcctcgaagggacaacagtcacgttcgaccatcagtggagtccaggcaagaagacgagctagactanacactgtacaaatagacagacagacaagtacgaacccagtagggctggtgggtgtcgggaggaacgggacctaaggcgtacgtacccgtacgtaaagtcgaacgcccgtaacggg

SEQ ID NO: 102828 - DNA, 553 bp, Homo sapiens
  misc_feature: GYAE6OF01DAPSP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattggcaaagctatatgcttactggtaccagcagaagccaggccacggcccctggtggtgtgatataataaagccgtgagacggccctcgagggactcccgtgagcgaaatcctcgtcggcctcccgaagtctacgaaggggacaaacgacgtcaacgtttgaaccatcagtggagtccaggcaagaagacgagctagactatcactgacaaatgacagacaagcaaagtcggaaccagtagggctaggtggtacggttcgggacgggaagggccgaacggtcgtacggtacccgtaccgtaaaggtccgaacgcccggtaacggg

SEQ ID NO: 102829 - DNA, 536 bp, Homo sapiens
  misc_feature: GYAE6OF01BS88C.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggactcccgtgagcgaatctcgtggctccagctcgagggacaacagtcacgttgaccatcagtggagtccgaggcagaagacgaggctgactatcactgtacaaatgacagaacagacaagtcggaacccagtaacgggctggttggtcggttcgggacgggacgggaaccgaaggtcgtacggtacccggtacgttaaaggcaacggccccgtaaacgggg

SEQ ID NO: 102830 - DNA, 506 bp, Homo sapiens
  misc_feature: GYAE6OF01CY0C0.3.34.D01.1.454.CMB.1.raw
  modified_base (461)..(461): a, c, t, g, unknown or other
  misc_feature (461)..(461): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccagcaagaagcgaggctgactatcactgtacaaatagacagacagacaatggacccaagtagggctggtaggtggttcgggnggaagggaccaaggctcgaaccgtacctaagtcagcccgaacggg

SEQ ID NO: 102831 - DNA, 526 bp, Homo sapiens
  misc_feature: GYAE6OF01B8HI6.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattggacaaagctatatgcttactggtaccagcagaagccaggccacggcccctgtggtggtgatataataaagaccgtgagacgccctgagggctccctgagcgaatctcgtggctccgagctcgagggacaacgagtcacgttgaccatcaggtggagtccgaggacagaacgacgaggctgactatcactgacaaatgacagacagacaagacggaaccaggtacgggctaggtggtggtcgggacggacggacgaacgcgtacgacccgtacgtaacgcacggcccgtaacggg

SEQ ID NO: 102832 - DNA, 540 bp, Homo sapiens
  misc_feature: GYAE6OF01DK6VJ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatataataaagaccgtgagacggcccctcgagggactcccgtagagacgaatctctggctccagctcgagggacaacagtcacgttgaccatcagtgagtccaggcaagagacgagctagactatcactgtacaaatagacagacagacaagtacggaacccagtacgggctaggtggtcggttcgggacgggtaacgggaacccaaggcgtacggtaacccgttaccgtaagtccgacgccccgtaaacggg

SEQ ID NO: 102833 - DNA, 553 bp, Homo sapiens
  misc_feature: GYAE6OF01B9EWW.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctgagggactcccgtgagcgaatctctggctccagctcgagggacaacgtagtacacggttgacccagtacaaggttggacgtccgaggaccaaggaagacgaggctaggaactatcaactgtacaaatagacagaacagacaataggaacccagtacgggctaggttggtcggttacgggacggaagggtaccaaggtccgtacggacccgttactaaggtccaacggtccccgtaaacggg

SEQ ID NO: 102834 - DNA, 313 bp, Homo sapiens
  misc_feature: GYAE6OF01D68BH.3.34.D01.1.454.CMB.1.raw
  modified_base (306)..(313): a, c, t, g, unknown or other
  misc_feature (306)..(313): n is a, c, g, or t
tcagagacgcactccacgaccggtgctcgatttagatcgtctgtgttgggtttggggtgaggtctgtgtcactgtggtattactagtggttcggggagttaaagcagatgtttactactactactactacatggacgtctggggcaaagggaccacggtcaccgtctcctcagcctccaccaaggcccatcggtcttcccctggcaccctcctccaagagcacctctggggcacagcggccctgggctgcctggtccaaggactacttccgagtgcgtctctgagcgggctggcaaggcgcatagnnnnnnnn

SEQ ID NO: 102835 - DNA, 538 bp, Homo sapiens
  misc_feature: GYAE6OF01B5WOR.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctatatgcttactggtaccagcagaagccaggccaggcccctgtggtggtgatatataaagaccgtgagagccctcgagggatcccctaggagcggaatcgtcgtagggctccgagctcgagggacaacagtcacgttgaccatcaagtgagtccgaggcagaagacgaggctggactatacacgtgtaccaaagtcgacaagacaagacaagtacggaaccagtagggtctggtaggtgttcgggacgggaaggaccgaagccgtaggacccgtacgtaagacgcgaccgtaaccggg

SEQ ID NO: 102836 - DNA, 545 bp, Homo sapiens
  misc_feature: GYAE6OF01A31B5.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccacggcccctgtggtggtgatatataaagaccgtgagacggccctcgagggactccctgagcgaatctctgctcagctcgagggacaacgagtcacgttgaccatcgagtggacgtccgaggcaaggaagacggaggctgactatcactagtacaaatgacaagacagacaagtacggaacccagtacgggtcttggtggttcggttcgggacgggacgggaacccgaaggtcctacggtacccgttacgtaacgtccgaaccggcccgtaacggg

SEQ ID NO: 102837 - DNA, 508 bp, Homo sapiens
  misc_feature: GYAE6OF01CHKVM.3.34.D01.1.454.CMB.1.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctgagggatcccgtgagcgaatcnctggctccagctcgagggacaaacngtcacgttgaccatcagtggagtccaggcaggaagacgagctgacctatcactgtacaaatagcaaggaacagacaaagtcggaacccagtaggctggtggtggttcggnggaggaccaaggcngaccgtacaagtcagcccgtaacgg

SEQ ID NO: 102838 - DNA, 668 bp, Homo sapiens
  misc_feature: GYAE6OF01C8MY1.3.34.D01.1.454.CMB.1.raw
  modified_base (280)..(280): a, c, t, g, unknown or other
  misc_feature (280)..(280): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacgccaggatcacctgctctggagatgcagttggacaaagctatatgtcttactgtaccagcagaagccaggccacggccccnggtggtggtgatatataaagaccgtgagacggccctcgaggactcctagagacgtaatctcgtacggctaccagcctacgaagggaccaaacgagtaccgtaacgttcgaacctagttaccgaggtacgggtacgtacccgaagggacgaaaggaaacggtaacggacgggtaccgtacggtaacctaacgtacctaacgttacggttaaccaaaagttacggaacaacggtaacaaggtaaccgtaaagttaaccgggaaccctaaaggttaaccggggtcgttcggggttaagggttccgggttaccgggggaacgggtacggggaaacccgacgggtacgtacggtaccccgttaacgtaagtacccgacgacccggtaaaccgg

SEQ ID NO: 102839 - DNA, 522 bp, Homo sapiens
  misc_feature: GYAE6OF01CXI6Y.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcgagggacaacagtcacgttgaccatcagtggagtccaggcagaagacgagctagactatcactgtacaaatagacagacagacaagtacggaacccagtacgggctggtgggtggttcgggagggaacgggaccaaggctacggacccgttaccgtaagtccgacggcccgaacggg

SEQ ID NO: 102840 - DNA, 372 bp, Homo sapiens
  misc_feature: GYAE6OF01A2FST.3.34.D01.1.454.CMB.1.raw
  modified_base (319)..(323): a, c, t, g, unknown or other
  misc_feature (319)..(323): n is a, c, g, or t
  modified_base (325)..(372): a, c, t, g, unknown or other
  misc_feature (325)..(372): n is a, c, g, or t
tcagagacgcactccacgaccggtgctcgatttagatcgtctgtgttggggtttggggtgaggtcctgtgtcactgtggtattacttatggtttcgggggagttaaagcagatgtttactactactactactacatggacgtctggggcaaagggaccacggtctaccgtctcctcagtcctccaccaagggcccatcggtcttccccctggcaccctctccagaggcacctctcgggggcacaggcggccctggggctggcctggtccaaggctacttccgagtgcgtctctgagcgggctgggcaaggcgcagtagnnnnngnnnnnnnnnnnnnnnnnnnnnnnnnnnnnnnnnnnnnnnnnnnnnnnn

SEQ ID NO: 102841 - DNA, 621 bp, Homo sapiens
  misc_feature: GYAE6OF01A0QN7.3.34.D01.1.454.CMB.1.raw
  modified_base (319)..(319): a, c, t, g, unknown or other
  misc_feature (319)..(319): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcacctgctctggagatgcagttggacaaagctatatgtcttaccgtacgacgacgacgaagaccacggaccgacggcccgtcgtggtggtgagtagtataaacgaacggngaggacggcccgtcgaggacgtccgtcgagacgtaacgtactcgtcggacgtccgacgacgtacgaacggacgaaacgtacgtacgtacgttacgaccgaacttcggaaggtacgggacgtaccgaaggtacgaaacggaaggacggtacggcgtactaactacgtacaacgttagtacgaaaactgccgtaaagaccgtagaccgaagtacggaacccgaagtgggaccgttagtgggttacggttcgggacggaaggaccgaagcgtcgaaccgttactaagacgacgaccccgtggccg

SEQ ID NO: 102842 - DNA, 545 bp, Homo sapiens
  misc_feature: GYAE6OF01DZ5DU.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctgagggactcccgtgacgacgaatctctggctccagctcgagggacaacgagtcacgttagaccatcgaggtgggactcgaggcaaggaagacggaggctgaactatccactgtacaaatagacaagacagacaagtacggaacccagtacgggctgggtggttcggttcgggacgggaagggacccaaggtcgtacggtaacccgtacgttaaaggcaccggcccgtaacggg

SEQ ID NO: 102843 - DNA, 496 bp, Homo sapiens
  misc_feature: GYAE6OF01BOA0R.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagccgtgagaggccctcagggatccctgagcgaatctctggctccagctcagggacaacagtcacgttgaccatcagtggagtccaggcagaagacgaggctgactatcactgtacaaatgacagacagacaatcggaacccagtagggctgtggtgtcggcggagggaccagctacggaccgtctaagcagcccgaacgg

SEQ ID NO: 102844 - DNA, 514 bp, Homo sapiens
  misc_feature: GYAE6OF01CM6EC.3.34.D01.1.454.CMB.1.raw
  modified_base (221)..(221): a, c, t, g, unknown or other
  misc_feature (221)..(221): n is a, c, g, or t
  modified_base (504)..(504): a, c, t, g, unknown or other
  misc_feature (504)..(504): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattggcaaagctatatgcttactggtaccagcagaagccaggccacggcccctgtggtggtgatataataaagccgtgagacggccctcgagggactccccgtgacgcgaatctcgtggcctccagctcgaacgggacaacagtcacgttgaccatcaggtgacgtccaggcaagaagacgagctgactatcaactgtacaaatgacagacagacaagtaggaacccagtagggctggtggtgtcgggcggaagggaccagcgtgtacccgtactagcncgccgaacgg

SEQ ID NO: 102845 - DNA, 505 bp, Homo sapiens
  misc_feature: GYAE6OF01COKRU.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatataataaagaccgtgagaggccctcgagggatcccgtgagcgaatctctggctccagctcgagggacaacgagtcacgttgaccatcgagtggagtccgaggcagaagacgaggctgactatcactgtacaaatgacagacagacaagtacggaccagtgggctggtggtggtcggcggagggccaaggctcgaccgtacgaagtcacgccgacgg

SEQ ID NO: 102846 - DNA, 722 bp, Homo sapiens
  misc_feature: GYAE6OF01CXWIV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacaggacggccaggactcgaccgtgctcgtggagatgcagttggacaaagctatatgtcttactggtaccagcagaacgccgaggccacggcccctggtcgggtggtgatagtaagtaaacgaccgtgaagacggcccctacgagggtactcccgtaggacgaccgaacttccgtcgttcgggccttaccgacgtccgtacggaacgggtaacaaccgtacgtaccgtaacgtttacggaacctagtacgtagggtacggacgtaccgaaggaccaaggaacggacggacgggtctaacggaactagtaccgtaacgttaggtaaacctaaagtacgaaccgaacggtaaaccgaggtaaccgtaaagtaacccgggaacccgtaaggtaccgggtacgtagggttacgggttacggggtttaccggggaacggggtaaacgggtacccgtaaacgggtccggttaaccggtaacccgggttacccgtaacggtacccggtaacccggaccccggttaaaccccgggg

SEQ ID NO: 102847 - DNA, 518 bp, Homo sapiens
  misc_feature: GYAE6OF01AWKR9.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctcgagggactccctgagcgaatctctggctccagctcagggacaacagtcacgttgaccatcagtgagtccaggcagaagacgaggctgactagtcactgtacaaatgacagaacagacaatacggaacccagtagggctgtggtggttcgggagggacgggaccgaaggctacggacccgtactaaggtcagccccgtaacggg

SEQ ID NO: 102848 - DNA, 496 bp, Homo sapiens
  misc_feature: GYAE6OF01A9LQB.3.34.D01.1.454.CMB.1.raw
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (474)..(474): a, c, t, g, unknown or other
  misc_feature (474)..(474): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtgaggaggccctnagggatccctgagcgaaatctcgtggcctccagctacgaggggacaaacacgtcacgttgaccatcagtggagtcaggcagaagacgagctgactancattgacaaatgacagacagcaatcggaaccagtaggctggtggtgtcggaggaggccagcngaccgtcaagtcagccgaacgg

SEQ ID NO: 102849 - DNA, 528 bp, Homo sapiens
  misc_feature: GYAE6OF01AHYZK.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagacggccctcgagggactcccgtgagcgaatctctggctcagctcgagggacaacagtcacgttgaccatcagtggagtccgaggcagaagacgaggctgactatcactgtacaatagacaagacaagacaaagtacgaacccagtacgggcttggtggtaggttcgggcgggaacgggccgaaggccgtacggtacccggtactaaggccacggcccgtaacgg

SEQ ID NO: 102850 - DNA, 532 bp, Homo sapiens
  misc_feature: GYAE6OF01CF4IN.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattggacaaagctatatgcttactggtaccagcagaagccaggccaggcccctggtggtggtgatatataaagaccgtgagaggccctcgagggactccctggacgacgaatctctggctcagctcgagggacaacagtcacgttgaccatcagtggacgtccgaggacagaagacgagctgactatcatgtacaatagacagacagacaagtacggaaccagtacgggctggtaggttggttcgggagggaacgggaccgaacggtcgtacggtacccggtacttaaggccgacgcccgaacggg

SEQ ID NO: 102851 - DNA, 327 bp, Homo sapiens
  misc_feature: GYAE6OF01EJZJ8.3.34.D01.1.454.CMB.1.raw
  modified_base (284)..(284): a, c, t, g, unknown or other
  misc_feature (284)..(284): n is a, c, g, or t
  modified_base (302)..(327): a, c, t, g, unknown or other
  misc_feature (302)..(327): n is a, c, g, or t
tcagagacgcactccacgaccggtgctcgatttagatcgtctgtgttgggtttgggggtgaggtctgtgtcactgtggtattactatggttcggggagttaaagcgacgatgtttactactactacgtactacatggacgtctggggcaaagggaccacggtcaccgtctcctcagcctcacaaggcccatcgtcttcccctgcacctctccaagagcacctctggggcacagcgccctgggctgcctggtcaaggactacttccgagtgcgtctctgagcggntggcaaggcgcactagcnnnnnnnnnnnnnnnnnnnnnnnnnn

SEQ ID NO: 102852 - DNA, 500 bp, Homo sapiens
  misc_feature: GYAE6OF01CBNP4.3.34.D01.1.454.CMB.1.raw
  modified_base (458)..(458): a, c, t, g, unknown or other
  misc_feature (458)..(458): n is a, c, g, or t
  modified_base (488)..(488): a, c, t, g, unknown or other
  misc_feature (488)..(488): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctgagggatccctgagcgaatctctggctcagctcgagggacaacacgtcacgttgaccatcagtggagtccaggcaggaagacgagctgactatcactgacaatagacagacagacaaatggaacccagtaggctggtggtgtcggnggacgggaccagctcgtaccgtactagtcngcccgtaacggg

SEQ ID NO: 102853 - DNA, 532 bp, Homo sapiens
  misc_feature: GYAE6OF01DX639.3.34.D01.1.454.CMB.1.raw
  modified_base (415)..(415): a, c, t, g, unknown or other
  misc_feature (415)..(415): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtgagaggccctcgagggactcccgtgagcgaatctctggctccagctcgagggacaacgagtcacgttagaccatcagtggagtcaggcaagaagacgagctgactatacatntacaaatgacaagacagacaagtacggaacctagtacgggctggtaggtggttccgggagggagggacccgaaggccgtacggtacccggttacctaagtccgacggcccgaacggg

SEQ ID NO: 102854 - DNA, 557 bp, Homo sapiens
  misc_feature: GYAE6OF01B2VXA.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattggcaaagctatatgcttactggtaccagcagaagccaggccaggcccctggtggtggtgatatataaagaccgtgagacggccctgagggtactcccgtgacgcgaatctcgtggcctccgagcctcgagggacaacgagtacacgttacgaccagtcgagtggacgtccgaggtcgaaggaagacgaggctagactatctactgtacaagtacgacagacagacaactacggaacccagtacggctggtgggttcggtcgggacgggaacgggaccaacggccgttacggtacccgttaccgtaaggtccaacggcccgtaacggg

SEQ ID NO: 102855 - DNA, 558 bp, Homo sapiens
  misc_feature: GYAE6OF01ET8QS.3.34.D01.1.454.CMB.1.raw
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctggtggtggtgatatataaagaccgtgagaggccctgagggactcccgtgacgcgaatctctggctccagctcgagggacaacagtcacgttnaccatcgagtggagtccaggcaagaagacgaggctggactancactcgtacaaagtgacagacagacaagtacggaaacccagtacgggtcctagggtcgggttcgggttccgggacggggaacgggaacccgaacggccgttacggtacccggttaccgtaaacggtcgaccggccccgtaaacggg

SEQ ID NO: 102856 - DNA, 313 bp, Homo sapiens
  misc_feature: GYAE6OF01C8DQ0.3.34.D01.1.454.CMB.1.raw
  modified_base (308)..(313): a, c, t, g, unknown or other
  misc_feature (308)..(313): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggccaccctcctccaagagcacctctgggggcacagcggccctgggctgcctggtcaaggactacttccgagtgcgtctctgagcgggctggcaaggcgcatagnnnnnn

SEQ ID NO: 102857 - DNA, 594 bp, Homo sapiens
  misc_feature: GYAE6OF01BKB3T.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctaatatgcttactggtaccagcagaagccaggccaggcccctgtggtggtgatataataaagaccgtgagaggccctcgagggatccctgagacgaaatctcgtcggctccgagctacgaggggacaaacgagtaccacgttgaccatccgagtggacgtcgaggcaagaagacgaggctgactatcactgtacaaatgacagaacacgacaagtacggaacccgtaaggtacgggacgttggttacgggttcggtaccggggtacggggaaacggggtaaccaaacgggtaccgtaacggtaacccgggttacccgttaaagggtacccaaccgggtaccccggtaaacccgggg

SEQ ID NO: 102858 - DNA, 505 bp, Homo sapiens
  misc_feature: GYAE6OF01AZFOO.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtcggtggtgatatataaagaccgtgagaggccctcgagggatcccgtgagcgaatctctggctccagctcgagggacaacagtcacgttgaccatcgagtggagtccaggcaaggaagacggagctgactatcactgtacaaatgacagacagacaatcggaaccagtacgggctggtggtggtcgggcggaggaccagctacgaccgtctaagcgagccgtaacgg

SEQ ID NO: 102859 - DNA, 509 bp, Homo sapiens
  misc_feature: GYAE6OF01CXPC3.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcaggaagacgaggctgactatcactgtacaaatgacagacagcaaagtcggaacccagtacgggctggtggtggttcgggcggagggaccaagctacgaccgtacctaagtccagcccgtaacgg

SEQ ID NO: 102860 - DNA, 537 bp, Homo sapiens
  misc_feature: GYAE6OF01DOWK1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaaagctatatgcttactggtaccagcaagaagccaggccaggcccctgtggtggtgatatataaagaccgtgagaggccctcgagggactccctgagcgaatctctggctccagctcgagggacaacagtacacgttgaccagtcaggtggactccgaggcaagaagacgaggctgactatcactgtacaaatagacaagacagacgaaatacggaacccagtaacgggctggttgggtcggttcgggagggtacgggaccaaggcgtacggtacccgtacctaagtccaggacccgtaacggg

SEQ ID NO: 102861 - DNA, 518 bp, Homo sapiens
  misc_feature: GYAE6OF01CGBQO.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggatcccgtgacgcgaatctcgtggcctccagcctcgaggggacaaacgagtcacgttgaccatcagtggagtccgaggcaggaagacgaggctgactatcactgtacaaatgacagacagacaagtcggaacccagtagggctgtggtggttcgggagggacgggacaaggctacggaccgtactaagcgagtccgaacgg

SEQ ID NO: 102862 - DNA, 641 bp, Homo sapiens
  misc_feature: GYAE6OF01DQRGG.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctggtggtgtgatatataaagaccgtgagacggccctgagggactcccctgacgacgaattctctggcctaccagcctacgaagggacaacgagtacctacggttacgaacctaatcgaggtacgggacgttacccgaagggccaaaggaaacggaccggagggacttagaaaccttattaccaacgttcggtaacaaaagtacgacgaacgaacgaagacctaaacgtacgggaaaccctaggtaaacgggtctagggttagggttcgggttaccgggaccggggtacggggaaaccctaaacgggtccttaccgggtaaccccgttaccgtaaacggtcccgaacggaccccgtaaacgggg

SEQ ID NO: 102863 - DNA, 309 bp, Homo sapiens
  misc_feature: GYAE6OF01CM2LW.3.34.D01.1.454.CMB.1.raw
  modified_base (307)..(309): a, c, t, g, unknown or other
  misc_feature (307)..(309): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 102864 - DNA, 725 bp, Homo sapiens
  misc_feature: GYAE6OF01EHG8U.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacgaggctctggacggccttcctatgagctgacacacgcccaccgtcggtgtcagtcgtcccgaggacacggaccggcaggtactccaccgtgcttcgtaggagattcgactagttcggaacaaagtctaatagtcgtacttacgtacggtaaccagacgaagaacgccgacggccaccggtcccctggtcggtggtagtactaagtaaagtaaacggtaccgtaggaggaccggtccctacggacgggtacctcccgtaggaacgacgtaactcgtcgtcggtcctaccgacgtccgtacggaacgggaccaacgtacgtcgtacggttacaaccatcgaggttacggacgttacccgaaggtaccgaaaggaacggaaccgagggtacctacggtaacttacgtacctacgtttaagaactaaacgtgaacgaacgtaacgaagtaaccgtaacgtacggaaacccctaggttaaaccggggtcttagggttacgggttacgggtttcggggaacccgggtaggggaaacccgtacggtacgtaccgggtaaccccttaacggtaacgcgtccggaacccggtaaccgg

SEQ ID NO: 102865 - DNA, 541 bp, Homo sapiens
  misc_feature: GYAE6OF01C9QA7.3.34.D01.1.454.CMB.1.raw
  modified_base (479)..(479): a, c, t, g, unknown or other
  misc_feature (479)..(479): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaaagctatatgcttactggtaccagcagaagccaggccaggcccctgtggtggtgatatataaagaccgtgagaggccctcgagggactccctgagcgaatctcgtggctccagctcgagggacaacagtcacgttgaccatcgagtggacgtccaggcaagaagacgaggctagactatcactgtacaaagtagacaagacagacaaagtacggaacccagtacgggactggtggtggttcgggngggaacgggaaccaaggtcgtacggtaacccggtaccgtaagtccgacggcccgaaaccggg

SEQ ID NO: 102866 - DNA, 318 bp, Homo sapiens
  misc_feature: GYAE6OF01DIL9L.3.34.D01.1.454.CMB.1.raw
  modified_base (311)..(318): a, c, t, g, unknown or other
  misc_feature (311)..(318): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggccaccctcctccaagagccacctcgtgggggcacagcggccctgggctgcctggtcaaggactacgttccgagtgcgtctctgagcgggctggcaaggcgcatagnnnnnnnn

SEQ ID NO: 102867 - DNA, 548 bp, Homo sapiens
  misc_feature: GYAE6OF01DDU18.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattggcaaagctatatgcttactggtaccagcagaagccaggccaggcccctgtggtggtgatatagtaaagaccgtgagaggccctcgagggactcccgtgagcgaatctcgtggctcagctacgagggacaacgagtcacgttgaccatcagtggacgtccgaggcaagaagacgaggctagactatcactgacaaatgacaagacagacaagcggaacccagtacgggctggttgggtggttccggggacgggacgggaacccgaacggtcctacggtaacccgttaccgtaaaggttccacgggccccgtaaacggg

SEQ ID NO: 102868 - DNA, 562 bp, Homo sapiens
  misc_feature: GYAE6OF01DBY0P.3.34.D01.1.454.CMB.1.raw
  modified_base (222)..(222): a, c, t, g, unknown or other
  misc_feature (222)..(222): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattggacaaagctatatgtcttactggtaccagcaagaacgccaggccacggcccctggtggtggtgatataataaagaccgtgagacggccctcgagggactcccgtgagcgaatctcgtcggctccagtctcgaacgggacacagtcaacgttnacatcagtggacgtacgagcgaagaagacggagctagactanctactntaacgaaatagacaagaacgagaacaagtacgaacctagtacggngtggtgggtcggttacggggacgggaagggtaccgaaggtccgtacggtaccccgttacgtaacgtaccgacggaccccgtaacggg

SEQ ID NO: 102869 - DNA, 678 bp, Homo sapiens
  misc_feature: GYAE6OF01CLA04.3.34.D01.1.454.CMB.1.raw
  modified_base (413)..(413): a, c, t, g, unknown or other
  misc_feature (413)..(413): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattggacaaagctatagtgcttactggtaccagacaagaacgccaggccacggcccctggtggtggtgaatagtaagtaaacggaccgtaggaacgacggccctacgagggactcccgtagacgcgtaatctcgtggcctcgagcctacgacgggaccaaacgtcgtactacggttacgacctancgtaggtggtacgtcgaggcaaggaacgacggaggactagtaactagtacacgttagtaaccaaagtcgaacgtacgaacgtacgaacgaaacgttaaccgggaaaccctaagggtaacgggttccgtagggttaccgggttaacgggttaccgggggaacgggggttaacggggaaaccccgaaacgggttacccggttaacccgggtaaccccggtttaaccgtaaacgggttcccgaaaccggtaccccggtaaacccgggg

SEQ ID NO: 102870 - DNA, 663 bp, Homo sapiens
  misc_feature: GYAE6OF01EYQBX.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaacgccaggccacggcccctggtggtggtgatataagtaaagaccgtagagacggccctcgagggactcccgtgacgacgaatctcgtcggctccgagcctacgaacgggtaaccaacgtacgtaccgtacggtttacgaaccctagttaccgtaaggttcgggtaacgtacccgaagggaccgaaaggaaacggaaccggagggtcttaggaaccttacgtaccgaacgttacgtaactaaaagtacgaacaacgaacgacgaactaaacgtaccgggaaaccctaggtaacgggtccgttagggtgggttacgggttccggggacggggtaacgggaacccgaaggtccgtacggtaacccggttaccgtaaaggttcccgaaacggtccccgtaaacggg

SEQ ID NO: 102871 - DNA, 560 bp, Homo sapiens
  misc_feature: GYAE6OF01ENQ4I.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccacggcccctgtggtggtgatatataaagaccgtgagacggccctgagggactcccgtgagcgaatcgtcgtggctaccagctcgagggacaacagtcacgttgaccatcagtggacgtccgaggcaagaagacgagctgactatcactgtacaaatcgacacgacgagacaatacggaacccagtacgggcttagggtcggttacgggttccggggacgggaacgggacccgaacggtccgtaccgggtaccccggttacgtaacggtcgaaccggcccgtaaaccggg

SEQ ID NO: 102872 - DNA, 607 bp, Homo sapiens
  misc_feature: GYAE6OF01CD1OS.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcagttggacaaagctatatgcttactggtaccagcagaagccaggccacggccccctgtggtggtgatatataaagaccgtagagacggccctcgacgggactccgtagacgacgtaatctcgtggcctaccagcctcgaacgggacaacgtagtactacgttacgaccatcgaggtggacgtccgaggcgaagaacgacgaggactagactagtacacgttagtaacaatacgacagacagacaagtacggaacccaaggtacggcgttaggtcgggttacggttccggggacggggaacggggtaacccgaacgggtaccggtaccggtacccggttaacccgtaaggttacccgaacggtaccccggtaaaccggg

SEQ ID NO: 102873 - DNA, 649 bp, Homo sapiens
  misc_feature: GYAE6OF01C5HB1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgctattggacaaagctatatgtcttactggtaccaggaccaagaacgccgaacgggccctaacggccccctggttgggtaggtgtaatataaagtaaacggaccgtggaacggaccgggtaccctcgaaaggggcttccccgaggacgaccggaattccgtcgttcggacctccgaagcctacgagggaccaaacacggttacacgttacgaccattacgaggttacggacgtacccgaaagacgaaggaaacgacggacggtcgtaacgtaactactcctacgtacgttacgaaattacgacaacggaacagacaacgtacggaaccctagtacgggtctaggttagggttcgggtaccgggtacgggagggtaacccgaggcctacggtaccctacgttaacgacgaccgccggtaaccgg

SEQ ID NO: 102874 - DNA, 745 bp, Homo sapiens
  misc_feature: GYAE6OF01CBOUD.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccgaggacagacggccaggatcacctgctcgtggagatgcagttggacaaagctaatatgtacttacgtggtaccagacaagaacgccgaggaccgacggccccttggtggttggtagattaagtaactaaacgaccggtgaacggacggcccctaggacgggactcccgtaggacgtaccgaattctaccgtcggacctaccgagtccgtacgaagggaaccaaacgtacggtacctaacggtttacgaccctagtaccgaggttacgggacgtacccgaagggtaccgaagggaaacggacggaacggcgtaacggtaaccttacgtaccgtaacgtttagaaacctaaagttaccgaactaacggaaaccacgggtaacctaaaggtaccccgggaaacctaagggttacgggtccgttagggtttaccgggtttacgggtcccggggaaacggggttaccggggaaacccctaagggtacccgttaaccggttaacccgggttaacccttaaagggtaccccgtaaccggggaaccccccggttaaacgggg

SEQ ID NO: 102875 - DNA, 543 bp, Homo sapiens
  misc_feature: GYAE6OF01BWQT5.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggatccctgagcgaatctcgtggcctcagctacgagggacaacagtactacgttgaccatcgaggtggacgtccgaggcaaggaagacggaggctagactatacactgtacaatacgacagacagacaagtacggaacccagtacgggtctggtagggttggttcgggacgggacgggaccgaacgtcgtacggtaccgtaccgttaagccacggacccgtaacggg

SEQ ID NO: 102876 - DNA, 679 bp, Homo sapiens
  misc_feature: GYAE6OF01EJZ2P.3.34.D01.1.454.CMB.1.raw
  modified_base (229)..(229): a, c, t, g, unknown or other
  misc_feature (229)..(229): n is a, c, g, or t
  modified_base (330)..(330): a, c, t, g, unknown or other
  misc_feature (330)..(330): n is a, c, g, or t
tcagagacgcactccacgaccggtgctcgatttagatcgtctgtgttgggtttgggggtgggtccaggaggcagaactctgggtgtctcaccatggcctggatcctctacttctcccctcctcactctctgcacaggctctgaggcctcctatgagctgacacacgcccaccctcgggtgtcagtcgtcccaggacagacggccaggatccacctgctctggagatgcncttaggcaaagctatatgctaactggtaccagcagaagccaggccaggcccctgtggtggtgaatatataaagaccgtgacgaggcccgtcgacgggtacncctacgtagcgtaacgtacgtctcggtacgtccacggcgacctacgggacgaaacctaacggtccgtaacgtacggtaccgtacgtacgtacgtacgggaggtaccgaacggaacgaacggaacgaaaccggacgggtacgtacgtacgtaaccgtacgtaactaacggttacgtaaacgtaagtaacgacgaacgtaacgaccgtaaactacgggtaacccgaacgtagggtacggttacggtacggggttacggttccgggtaacggggtacgggtaccggaaccggaccgttaacgtacccggtaaccgttaaaccggtaccgtaacggtaccccgtaaacccggg

SEQ ID NO: 102877 - DNA, 710 bp, Homo sapiens
  misc_feature: GYAE6OF01CXD1C.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacacgcccacccgtcggtgtcagtcgtccccgaggacaggaccggccaggatcacctgctcgtggagtatgactagttcggacaaaagtctaatagtcgtactttacgtacggtaccagacaagaacgccgaggcccgacggccccttggtcggttaggtagaagtactaaagtaaaacggaccggtagaacggaccggaccccttacggacgggaccttaccccgtaggacgtaccgtaattccgtcgttacggacctaccgaagtcctacggaacgggtaacaaacgtacgtacaccgttcgaacctagtacgtaggtagggtacgtaccgaggacaaggaacgaggacggtactaacggaactacgtactacgtagtaacaaatacgactaacgaacgaagaacgtaacgtaacggaacccgtaaggtagggttaccgtaggtttacggggttacgggtaccggggtagggaaacccgggtaacggacggtaccgttaccgggaacccgttaaccgaaggtccccgaaggaccccggtaacggg

SEQ ID NO: 102878 - DNA, 570 bp, Homo sapiens
  misc_feature: GYAE6OF01EL6AF.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcagttggacaaagctatatgcttactggtaccagcagaagccaggccaggcccctggtggtggtgatataagtaaagaccgtgaggacggccctcgagggactcccgtgagcgaatctcgtggcctccgagctcgagggaccaacgagtcacgttcgaccatcaggtggacgtccgaggacaagaagacggaggctagactatcatgtaacaaatgacagaacagacaagacggaacccagtacgggcttgggtgggttggttccggggacgggaacgggacccgaaggtccgtacggtacccggttaaccgtaaaggtcccgaaccggaccccgtaaccgggg

SEQ ID NO: 102879 - DNA, 630 bp, Homo sapiens
  misc_feature: GYAE6OF01DVN6B.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgtcttactggtaccagcagaagccaggccaggcccctgtggtggtgatataataaagaccgtgagacggccctgagggactcccgtgacgcgaatctcgtggctccagctcgagggacaacgagtaccacgttacgacctatcgagtggacgtaccgaggacaaggaagacggagcgtacgactatcaacttgtacaaagtacgacaagacgtacgactaaagtaccggaaccctaaggtaaccggggtcgttacgggttacggggtttacgggtttacccgggggaaccggggtaaccggggaaacccgtaaccgggtacgtacccgggttaacccggttaacccgttaacggttacccggaacccggtaaccccggtaaacccggg

SEQ ID NO: 102880 - DNA, 646 bp, Homo sapiens
  misc_feature: GYAE6OF01DP15V.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattggacaaagctaatatgctttactggtaccagcaagaacgccaggccaggcccctgtggtggtgatatataaagaccgtgaggacggcctgagggactcccgtgagcgaattcgtcgtggcctccgagtcctacgaagggtaccaaacgtagtacctacggttacgaaccagtacgaggttagggacgtacccgaagggacgtaaaggaaaggaccggaaggccgttagaaccttaatccgaacgttacgtaaccaaaagtcggaccaacgacaacggacctaaacgtacggaaaccctaggtaacgggtcgttacgggttgggttacgggttaccggggacgggtaacgggtaaccgaacggtccgttacggacccgttaaccgtaaggtacccgacgtaccccggtaaaccggg

SEQ ID NO: 102881 - DNA, 640 bp, Homo sapiens
  misc_feature: GYAE6OF01BJ064.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccacccgtcggtgtcagtcgtccccgaggacaggaccggccaggactcacctgctcgtggatatgcagttggacaaagctaatatgtcttacgtcggtaccagacagaacgaccgacggccgacggccccgtggtcggtggtgataataataagaccgtagagacggtcctacgaggactccgtagagacgtaactctacgtcggcctaccgcgctacgacgggaacaaacgtacgtacgtacgttacgacctagtacgaggtcggacgtaccgaggacgaaggaaacggacggacggactagactactccgaacttaggtaactaaagtagacgaacgacgtaacgaactaagtaaccggaaccgtaagtacggggtacgtagggttacgggttacgggtaccggggtacgggaacgggtaccggacgtacgtacggacccgttacgtaacgacgaaccgccgtaaccgg

SEQ ID NO: 102882 - DNA, 564 bp, Homo sapiens
  misc_feature: GYAE6OF01A3KPF.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggacaaagctatatgcttactggtaccagcagaagccaggccacggcccctgtggtggtgatataataaagaccgtagagacggccctagagggactcccgtgacgacgaatcgtcgtcggcctccgagtctacgaacggggaccaaacgagtaccacgttacgaacctatacgagtggacgtaccgaggacaaggaacgacggaggctagactatcacgtgtacaatgacagacagacaatacggaaccagtacggcgttaggtggtcggttcgggacgggaacggaccgacgcgtacggtacccgttacgtaagccgaacgtcccgtaacgg

SEQ ID NO: 102883 - DNA, 715 bp, Homo sapiens
  misc_feature: GYAE6OF01BNDDF.3.34.D01.1.454.CMB.1.raw
tcagagacgcactccacgaccggtgctcgatttagatcgtctgtgttgggtttggggtgggtccaggaggcagaactctgggtgtctcaccatggcctggatccctctacttctcccctcctcactctctgcacaggctctgaggcctcctatgagctgacacagccaccctcggtgtccagtcgtaccccaggacaggacggccaggactccacctgctcgtggagtatgctaagttggacaaagtctaatatcgtcttacgtgtaccagacagaacgccacggccacggcccctggtcggtggtagacgttagtaataaacgaccggtaggacggacggaccctacggaacgggtacttacccgtaggacgtacgtaacgtcgtacgtggtacctacgtacgtccgtacgaacgggtaacaacgtacgtaccgtacgttacgaccctagttaccgaggttacggtacgtcccgaaggaccgaaacggtaacggaaccgaggtaccgtaacgtaaccgtaacgttaccgacgttagtaaaccgtaaagttacgactaacggaaccgtacgtaaccgaaacgtaccggaaacccgtaggtacgggacgtttacggtaggggttccggtaccggggtacgggaacgggtaacccgacgggtacgtaccggaacccggtttaccaacgggttccctaaccgggtacccgtaaccggg

SEQ ID NO: 102884 - DNA, 607 bp, Homo sapiens
  misc_feature: GYAE6OF01BBXQG.3.34.D01.1.454.CMB.1.raw
  modified_base (476)..(476): a, c, t, g, unknown or other
  misc_feature (476)..(476): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggatcacctgctctggagatgcattggacaaagctatatgcttactggtaccagcagaacgccaggccacggcccctgtggtggtgatataataaagaccgtgacgacggccctcgagggactccccgtggacgcgaatcgtactggcctaccagcctacgaggggaaccaacgacgtctacgttacgaccatacgtaggtcggacgtccgacggacgaaggaaacggacggagggacgtacgactataccgtacgttacgtacaaanaacgtttacagaacgaagactaacgacggaacccgaagtacgggtacgtggtgggttcggttcgggacgggaacgggaaccggaagccgtacggtacccgtaccgtaagtaccgacggacccgtaaccggg

SEQ ID NO: 102885 - DNA, 521 bp, Homo sapiens
  misc_feature: GYAE6OF01EM198.3.34.D01.1.454.CMB.1.raw
  modified_base (248)..(248): a, c, t, g, unknown or other
  misc_feature (248)..(248): n is a, c, g, or t
  modified_base (360)..(360): a, c, t, g, unknown or other
  misc_feature (360)..(360): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttacnggtaccagcaagaagccaggccaggcccctgtggtggtgatatataaagccgtgagaggccctgagggactccctagacgcgaatctcgtggctccagcctcgagggacaanagtcacgttgaccatcgagtggacgtcgagacaagaagacgaggctgactatcactgtacaaatcgacaagactagacaatcggaacccagtaggctggtggtcgttcgggaggacgggaccaagtctacggacccgttacgtaagtcacgcccgtaacgg

SEQ ID NO: 102886 - DNA, 581 bp, Homo sapiens
  misc_feature: GYAE6OF01BJ4PJ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagacggccaggatcacctgctctggagatgcattggcaaagctatatgcttactggtaccagcagaagccaggccaggcccctggtggtggtgatatataaagaccgtagagacgccctacgagggactcccgtagagcgaactctcgtgctccagctcgagggacaacgagtcacgttcgactatcagtggagtccaggacagaaagcgaggctagactatacactagtacaaagtacgactagaacgtagacctaagtacggaacctagtaacgggtctagggttacgggtcgggttaccgggacgggaacgggaacccgtaacggtccgtaccggtaacccgttaccggtaaggttacccgaacggtccccgaaaccggg

SEQ ID NO: 102887 - DNA, 499 bp, Homo sapiens
  misc_feature: GYAE6OF01BG7AN.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggatccaagcagaagacgaggctgactatcactgtacaatagcagacagacaatcggaacccagtagggctggtggtggttcggacgggagggaccagctaggaccgtcaagtcagcccgaacgg

SEQ ID NO: 102888 - DNA, 729 bp, Homo sapiens
  misc_feature: GYAE6OF01AVG7Z.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattggacaaagtctatatgtacttacgtggtaaccagacgagaacgccgacggccacggcccctggtgggtcggtagaattaagtaaacgtaaaacggtacccggtaggaacggaccggtaccccgtacgaacggggtaccttccccgtaggaacggtaccgtaaacttccgtacgtcgggaccttcccgaggtacctacggaacgggaacctaaacgtacggttacctacggtttaccgaaccgtaatacgacgggttagggacgtaccgaaggtacgaacggaaacggacgaacgggcgttacggaacttactacctaacgttagtaaaccgtaaagtacgaccaaacggactaacgactaaacggtaaccggaaacccgtaggtacgggtcgttagggtcggggttacgggttaccggggagggtaacgggaccgtaacgggtacctaccgggtaacccgttaacgttaaacggaccgtaacccggacccgtaacccggg

SEQ ID NO: 102889 - DNA, 709 bp, Homo sapiens
  misc_feature: GYAE6OF01C9XSH.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctagacacacgcccacccgtggtgtcagtcgtcccgaggacagacggccaggactccacctgctcgtggagatgactagttggacaaagtcttaatagtgtactttacgtacggtaccagacaagaacgccgacggacccgaccgggtccccttgggtgggttcgggtagaagttaattaacgtaaaacgggtaccgtagggaacgacgggtccctacggacgggtacctcccgtaggacgtacggtaacttctcgtcggcctacgacgcctaggaacggtacaacgtacgtcgtaacgttcgactagtacgaggtacgacgtaccgaggacgaaggaacgacggacgtcagaactacgttacaacgtgtaaacaagtacgaacaacggaacctaacgaacaagtaaccgggaaacccgtaggttagggtaccggttacgggtagggttaccgggttccgggggaaacggggtaaccggtaaccgaacgggtcccgttaacggtaacccggttaccgtaacggacccggaccggtaaccccggtacccggg

SEQ ID NO: 102890 - DNA, 744 bp, Homo sapiens
  misc_feature: GYAE6OF01BFI32.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctagttggacaaagctatatgtcttacgtggtaccagaccagaagccgaggccacggcccctggtggtggtagataagtagtaaaagaccgacgaggacggccctcgagggactccctagacgcgaatcgtcgtggcctccgagtcctacgacgggaacaaacgtagtaccgtaccggttacgaaccctaagtaccgtaagggttacggacgttacccggaagggacgaaacggaaaagggaaccggtagggaccttaaggtaacctttaacgtaccgaaccgtttagtaacccgtaaaagtacggaaccaacggtaaacaacggtaaccaaaggtaacccgggtaaaccccgtaaagggttaaccggggtaaccgttcggggtttaacggggttccggggttaaccgggggaccggggtaaaccggggaacccggtaaacgggtccgttaaccggggtaaccccggttacccgttaaaaccgggtccgaaaccccggtaccccggtaaacccgggg

SEQ ID NO: 102891 - DNA, 571 bp, Homo sapiens
  misc_feature: GYAE6OF01A6JLN.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccacggcccctggtggtggtgatatataaagaccgtgagacggccctacgagggactcccgtgacgacgaatctactggctccagctcgagggacaacagtacacgttacgaccatcgaggtggacgtccgaggacaaggaacgacggaggctagactatcactgacaaatagacagacagacaagtacggaacccagtacgggcgttaggtgggttcggttaccgggacggggaacgggaacccgaaggccgttacggtaacccggttaccgtaaaggtcccgaacggaccccgtaaccggg

SEQ ID NO: 102892 - DNA, 708 bp, Homo sapiens
  misc_feature: GYAE6OF01D4YYJ.3.34.D01.1.454.CMB.1.raw
  modified_base (242)..(242): a, c, t, g, unknown or other
  misc_feature (242)..(242): n is a, c, g, or t
  modified_base (348)..(348): a, c, t, g, unknown or other
  misc_feature (348)..(348): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatccacctgctctggagatgcattggacaaagctatntgcttactcggtaccagcagaagccgaaggccacggcccctggtgggtggtgatataataaagaccgtgagacggccctgagggactcccgtgacgcgaatctcgnggcctaccgagctacgagggaccaacagtacctacgttacgacctagtcgaggtcggagtacccgagggaccgaaggtaacggacggaacgggtcgtacgaacttacgtaccgtaagttacgtaacctaaaagtacgaccgaaaggtaacgaaccgtaacgtaaaacgttacccgggaaaccccgttaaggggttaaccggggtacgtttacggggtttacgggggtttacgggtttaccggggggaaccgggggtaaaccggggtaaacccgaaaccgggttcccggttaacccgggtaaccccggtttaacccgttaaaacgggttccccgaaaccggtaccccgggtaaacccgggg

SEQ ID NO: 102893 - DNA, 657 bp, Homo sapiens
  misc_feature: GYAE6OF01C8WPQ.3.34.D01.1.454.CMB.1.raw
  modified_base (176)..(176): a, c, t, g, unknown or other
  misc_feature (176)..(176): n is a, c, g, or t
  modified_base (547)..(547): a, c, t, g, unknown or other
  misc_feature (547)..(547): n is a, c, g, or t
  modified_base (579)..(579): a, c, t, g, unknown or other
  misc_feature (579)..(579): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctctatgagctgacacagccaccctggtntcagtcgtcccaggacagacggcaggactcacctgctcgtggagatgctagttggacaaaagctaatatgtcttacgtggtaaccagacaagaacgccgacggaccgaaccggtcccctgggtgggtggtagaagttaataaacgtaaacggaccggtaggaacggaccggtacccctacggaaggggtacctaccccgttaggacggaacgtaacttccgtacgttcgggacctccgaacgtccgtacggaacgggaaccaaacgtacgtcgtacgttacgacctagtaccgaggttacggactaccgaggacaaggaaggaccgaggtactacgaactctactacgtataacaaatacgaacaacgaanacgaacaacgtaaccggacctaggtaacgggngttgggtacggttcggtcggggaggtaacgggaaccaggtccgtacggtacccgtactagacccacggcccgtaacgg

SEQ ID NO: 102894 - DNA, 675 bp, Homo sapiens
  misc_feature: GYAE6OF01AED5X.3.34.D01.1.454.CMB.1.raw
  modified_base (305)..(305): a, c, t, g, unknown or other
  misc_feature (305)..(305): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggaccggccaggatccacctgctctggagatgctattggacaaagctatatgtcttactggtaccagcagaacgccacggccacggcccctggtggtggtgactatanaaagaccggtagagacgccctagacgggactccgtagacgacgaactctacgtcggctaccagctacgaacgggacaaacgcgtactacggttacgacctagtcgaggttggacgtaccgaggaccgaaggaacggacgtacggtactacggaccttagtacctaacgttaccgttaacgaaaacgttcggaactaacggaaccgacgtaaccgaaacgtaaccggaaacccgtaggtacgggtaccgttagggttagggttaccgggttacggggaccggggtaacgggtaaacccgtaagggtccgtaacccgggtaaccggttaaccccgtaaggtaccccgtaccgggtaccccggtaaacccggg

SEQ ID NO: 102895 - DNA, 696 bp, Homo sapiens
  misc_feature: GYAE6OF01DL1BA.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccctacccgtcggtgtcagtcgtccccaggacaggacggccaggatccacctgctcgtggagatgctagttggacaaagcttaatatgtacttacgtaggtaccagacagaacgccgacggaccgacgggcccctgggttggtagggtataagttaataaacgtaaacggtaccggtaggaacggtacggtaccccgtaggaacgggtacctacccgtaggacggaccgtaaacgtccgtcgtcggtcctaccgtacgtaccgacggaacgggtaaaccaaagtacgtacgtaaccgttacgaacctagtacgtaggtcggacgtcgacgacgaaggaacggtacggagcgtagactatcaacgtataacaaagtgaacgagaacgacgaacgttaagaaccgaaccgtaggtacggtcgtcgggtacgggttcgggtacccgggagggtaaacgggacccgtaacggtacggttaccgggtaaacccggttacgtaaaccgtccggaaaccggccggtaaaccccggg

SEQ ID NO: 102896 - DNA, 703 bp, Homo sapiens
  misc_feature: GYAE6OF01B5AGN.3.34.D01.1.454.CMB.1.raw
  modified_base (556)..(556): a, c, t, g, unknown or other
  misc_feature (556)..(556): n is a, c, g, or t
tcagagacgcactccacgaccggtgctcgatttagatcgtctgtgttgggtttgggggtgggtccaggaggcagaactctgggtgtctcgccatggcctggatccctctacttcctcccctcctcactctctgcacaggctctgaggcctcctatgagctgacacagccaccctggtgtcagtcgtaccccaggacaggacggccaggatcacctgctcgtggagatggctagttggaacaagcttatacgtcgttacgttacgtacggtaaccgagacgaaacggaaccgacggaccgaccggtacccggtccgtagggttagggtacggtaataacgttaagtaaaacgttaaaccggacggtaggaacggtccggtaccgtacgggtacgtacccttccgaaggtacgtacgtaacttcgtcgtcgtacctacgacgtcgaacggacgaacaccgtagaccgtagtaccgactagtcggaacgtcgaacgacggtaagacgtaaggaaccggtgacgtagtacgtaacgtctacgtacgtaacgaattaaacncggaactaacgacgtaacgaacgttacgaacccggactagggaccggttgttcgggtagggtaccgggtaccgggaacgggtaacggtaacgtccggtaaccgtaccggttaaccgtaccggtaagcggtaacccgacggtacccgg

SEQ ID NO: 102897 - DNA, 742 bp, Homo sapiens
  misc_feature: GYAE6OF01CN7VZ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcagttggacaaagctatatgcttactggaccagcagaacgccgacggccacggccccgtggtcggtggtagaattagtaagtaaacggacccggtaggacggacggtcccctacggacgggtactccccgtaggacggaccgtaacgttcctacgtcggccttaccgagtcctacgaacgggaacaaacgacggtacctacggttacgaacctagtctacgggtacggtaacgttcccgaaggtacaaggtaaacggaccggacgtacgttagaccttacgtaccgtaacgttagtaacctaaaggttcgaaccgtaaggtaacccgaaggtaacccgtaaaggtaccggtaaaaccccggtaggtaaaccggggttcgttacggggttacgggttacggggtttaccggggccgggggaaaaccgggtacccgtaaaccgggtccgttaacccgggttaacccgggttacccgtaaacggttacccggacccgggaaaccccggtaacccggg

SEQ ID NO: 102898 - DNA, 613 bp, Homo sapiens
  misc_feature: GYAE6OF01COUAX.3.34.D01.1.454.CMB.1.raw
  modified_base (402)..(402): a, c, t, g, unknown or other
  misc_feature (402)..(402): n is a, c, g, or t
tcagagacgcactccacgaccggtgctcgatttagatcgtctgtgttgggtttgggggtgggtccaggaggcagaacttctgggtgtctcaccagtgggcctggatccctctacttcctcccctcctcactctctgcacaggctctgaggcctcctatgagctgacacagccaccctcggtgtcgaggtcgtccccgaggacgaggacggccaggactcacctgctcgtggacgatgcagttggacaaagctatactgtacttacgtcgtaccagacaagacgccgacggccgaccggtcccgtaggtgggtggtactaattaagtaacgtaacggtaccggtaggacggaccggccctacggacggtacctccgagacgtacgtactcgtcgtcgcctacncgtccgacgacggacacgtacgtctacgtacactacgtacgtaggtcgacgtccgacgtacgaaggacggacggacgtacgtacgtactacactacgtacgaacgaagtacgacagacagacaacgacgacgtagtcggtgtgggtggtacgggtcgggagggacggacctacggaccgttacgtaccgtacgtaccgacgaccgacgtcg

SEQ ID NO: 102899 - DNA, 582 bp, Homo sapiens
  misc_feature: GYAE6OF01EQY37.3.34.D01.1.454.CMB.1.raw
  modified_base (468)..(468): a, c, t, g, unknown or other
  misc_feature (468)..(468): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatccacctgctctggagatgcattgggacaaaagctaatattgacttacgtggtaccagcagaacgccacggccacggccccgtggtgggtggtagataataagtaaagccgtagacggacgcccgtcgagggactccctggagacgaattcctagtcggcctcacgctacggagggaacacagtcctagttcacctatcgaggtgacgtcgaggacaagaacggacgacgctagactactcactagtacaaagtgacaanaccgagactaagaccggaacctaggtacgggtactggtcgggtcggttcggacgggaagggtaccgaagccggtaacgtcccggtataacggtcaaccggtacccgtaaccggg

SEQ ID NO: 102900 - DNA, 606 bp, Homo sapiens
  misc_feature: GYAE6OF01EI6LM.3.34.D01.1.454.CMB.1.raw
  modified_base (343)..(343): a, c, t, g, unknown or other
  misc_feature (343)..(343): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatcacctgctctggagatgcattggacaaagctatatgtcttactggtaccagcagaagccaggccacggcccctggtggtggtgatataataagcgtgagaggccctagagggactccgtgagacgaatctcgngctccagctacgagggaaccaacgtacgtactacgttacgacctaagtccgaggtggaacgtccgaaggacgaaggaaggacggagggtactaggtaacctagtacctacgtagtaaccaaatacgacaagacaagacaaagtaccggaacccgagtacgggtcgttagggtgggttcggttccggggacggaacggggaacccgaacggtccgtaccgggtacccgtaacgtaacggtacccgaaccggcccgtaaaccggg

SEQ ID NO: 102901 - DNA, 818 bp, Homo sapiens
  misc_feature: GYAE6OF01EIMQJ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctggaggcctcctatgagctgacacagcccaccctcggtgtcagtcgtccccaggacagacggccaggatcacctgctctggagatgcagttggacaaagctatatgtcttacgtggtaccagacaagaacgccaggccgacggtccccgtggtgggtggtagtaagttaataacgtaaaacggacccgttaggaacggaccggtccctacgaagggtacctccccgtaggaacgtacgtaaacttccgttacgtcggtcctaccgacgtaccgttacggaacgggaaccaaacggtacgttaccgtaaccggttacgaacctaagtaccgtaagggtacgggtaaccggtaccggaagggaaccgaaagggaaacgggaaccggtaacgggtaccgttacggtaaacctttaacgtacctaaacggtttacgtaaaacgtaaaaccgttacggaaccgtaaacgggaaccgtaaacggtaaccgaaaacgttaaccccggggaaaacccgttaagggttaaccgggggtccttagggggttacggggtttacgggttaccggggggaacggggtaaccgggtaaaccggaaccgggttacccggttaaccccgggttacccgttaaccggttaaaccggtacccggtaaacccggtacccccgggtaaacccgggg

SEQ ID NO: 102902 - DNA, 669 bp, Homo sapiens
  misc_feature: GYAE6OF01CN75Q.3.34.D01.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtgtccccaggacaggacggccaggatcacctgctcgtgganatgcattggacaaagctatangtcttactggtaccagacgagaacgccgacggccgacggtcccctggtggtggtgtatataagtaaacggccgtagaggtacgccctgacgggtctccgtggacgcgaattcctacgtcggcctccgagtcctacggacggaacaacgtacgtcgtacgtacgacctatcgaggtcggacgtccgaaggtacaaggaacgacgacgggtaccgtaggaaccttactacgaacgttagtaaaccgaaagtaccgtaacgaacgtaaccgacgaaccgtaaacggtaacccggaaccgtaacgggttagggtccgttacgggtaggggttccggttaccggggcgggtaaacggggaccctaacggtacggttaccgtaacccggttaccgttaacggaccgtacccggtacccggtaacccgggg

SEQ ID NO: 102903 - DNA, 534 bp, Homo sapiens
  misc_feature: GYAE6OF01CI8D3.3.34.D01.1.454.CMB.1.raw
  modified_base (389)..(389): a, c, t, g, unknown or other
  misc_feature (389)..(389): n is a, c, g, or t
  modified_base (445)..(445): a, c, t, g, unknown or other
  misc_feature (445)..(445): n is a, c, g, or t
  modified_base (501)..(501): a, c, t, g, unknown or other
  misc_feature (501)..(501): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctggagatgcattggcaaaagctatatgcttactggtaccagcagaagccaggccacggcccctggtggtggtagatataataaaagaccgtgagacggccctcgagggactcccgagagcgaaatctcgtggctccagctcgaagggacaacagtcacgtgaccatcaggngagtaccgaggcaagaagacgacgctagactatcacttgaacaatagacagaacanacaagtacgaacctagtaggctggtaggtggttcgggacgggacggtaccgaacgngtacgaccggttacaacgtcaacgcccgaacgg

SEQ ID NO: 102904 - DNA, 613 bp, Homo sapiens
  misc_feature: GYAE6OF01AN9IS.3.34.D01.1.454.CMB.1.raw
  modified_base (298)..(298): a, c, t, g, unknown or other
  misc_feature (298)..(298): n is a, c, g, or t
  modified_base (457)..(457): a, c, t, g, unknown or other
  misc_feature (457)..(457): n is a, c, g, or t
  modified_base (480)..(480): a, c, t, g, unknown or other
  misc_feature (480)..(480): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatccacctgctctggagatgcattggcaaaagctatatcgtcttactcggtaccagcgaagaagccaggccacggcccctggtcggtgggngtatatagtaaaggaccgtgaggcgccctcgagggctccgtgacgcgaacttctcgtgacctccgaagctacgaggaccaacgacgtactacgttacgacctagtcgtagcggtacgccgaggacgaagaaggacggacgctagaactcgtacacttanacgaaagtcgactagacacgtanaacgttaccgaaccgtagtacgggacgttggtacgggtacgggttcgggaccggggaaacggggtccaacggtacccgttaacggtacccccggttaacgtaaacggccgttaaccggaacccgtaacccggg

SEQ ID NO: 102905 - DNA, 649 bp, Homo sapiens
  misc_feature: GYAE6OF01DBUAC.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggccctcccatgagctgacacagccaccctcggtgtcagtgtccccaggacagacggccaggatcacctgctctggagatgcattggacaaagctatatgcttactggtaccagcagaagccaggccaggcccctggtggtggtgatatataacgacgtgagcgccctgaggactcccgtgagcgaatcgtctggcctccgagtccgtacgaggggaaccaaacgtacggtacctacgtttacggaccctaagtaccgaagggtttacgggaacgttacccgaagggacgaaagggaaacggaaccgggaacgggtaccgttacgggaaaccttacgtacctaaccgttaggtaaccaaagtaacgaccaacggacaagaccaagtaccggaacctaggtacgggtctagggttcgggttcgggttaccgggacgggaacgggtacccgaaagggtccaccggtacccgttaaccgtaaggtacccgacgtaccccgtaacggg

SEQ ID NO: 102906 - DNA, 753 bp, Homo sapiens
  misc_feature: GYAE6OF01DHGYM.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcactgctctggagatgctagttggacaaagctatatgcttacgtggtaccagcagaacgccaggccacggcccctggtgggtggtagataataataaacgaccgtagagacggccctagagggactccgtgacgacgaactctcgtcggcctaccgacgccgtacgaacggggaacaaacgtacgtaccgtacggttacgaacctagtaccgtaaggtcggacgtacccgaagggaccgaaagggaaacggaacggaacgggtacgtaacggtaaccttaacgtaccgtaacgtttacggtaaactaaaacgttcggaaaccgaacggtaaaccgaacggtaaaccgtaaacggttaacccgggaaaaccccgtaagggttaaccggggtaccgtttcggggttaggggttccggggttaaccgggggaccggggtaaaccggggtaaacccgtaagggtaccccggttaaccggggtaacccccggtttaaccggtaaaaccggttcccggaaacccgggtaaaccccgggtaaacccgggg

SEQ ID NO: 102907 - DNA, 509 bp, Homo sapiens
  misc_feature: GYAE6OF01AWDXR.3.34.D01.1.454.CMB.1.raw
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtggtggtgatatataaaggaccgtagagaggcccctgaagggatccccgtgacgcgaatcgtctggctccagctcgaggggacaacagtcacgttgaccatcagtggagtccgaggcaagaagacgaggctagactancactgtacaaagtgacaagacagacaagtcgaaccagtagggctggnggtggtcggcggagggccagctgaccgtcagtcngcccgtaacgg

SEQ ID NO: 102908 - DNA, 542 bp, Homo sapiens
  misc_feature: GYAE6OF01AMTSD.3.34.D01.1.454.CMB.1.raw
  modified_base (336)..(336): a, c, t, g, unknown or other
  misc_feature (336)..(336): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagccgtgagacggccctcacgggatcccgtgacgcgaatcnctcgctcgagctcgagggacaacgagtccacgttcgaccataccgaggtggacgtccgaggacagaacgacgagggcctagactatcactgtacaaatacgacagacagaccaagtacggaccagtacggctaggtaggtcgttacgggcgggacggacccgaaggcctacggaacccgtacgtaacgtcgaaccgcccgtaacgg

SEQ ID NO: 102909 - DNA, 663 bp, Homo sapiens
  misc_feature: GYAE6OF01AU74A.3.34.D01.1.454.CMB.1.raw
  modified_base (269)..(269): a, c, t, g, unknown or other
  misc_feature (269)..(269): n is a, c, g, or t
tcagagacgcactccacgaccggtgctcgatttagatcgtctgtgttggggtttgggggtgggtccaggaggcagaactctgggtgtctcaccatggcctggatccctctacttctcccctcctcactctctgcacaggctctgaggcctccgtatgagctgacacagccaccctcggtgtcagtgtccccgaggacagacggcaggatcacctgctctggagatgcattggacaaagctatatgacttactggtaccagtcaagaacnccacggaccaacggcccctgtcggtggtacgaataactaataaaagaccgttaagaggacggcccttacgaacggggtactcccgtaggacgacgtaactcgtctacggtcctccgagcctacgacggggaacaacgtacgtacctaccggttacgaacctagtaccgtagtcgggtacgtccgaacggtaccgaaggtaacggacgtaacgggactacgactactaccgtactagtaacaaagtacgacaagacaagtacaactacgggaacctaggaggtcgtagggtacgggttacgggttaccgggacggggtaacgggaaccgtaacgggtacccgtacgggtaaccccgttacggtaaacggtccgaaccggccccggtaaacccggg

SEQ ID NO: 102910 - DNA, 854 bp, Homo sapiens
  misc_feature: GYAE6OF01BZBWB.3.34.D01.1.454.CMB.1.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctctgganatgcattggacaaagctatatgtacttactggtaccagcagaacgccgaggccgacggcccctggtcgggtggtagattaagtaagtaaacggaccggttaggacggacggccctacggacgggtactcccgtaggacgacgtaacgttcgtccgtcgggtcctccgaacgtcgtacgaacggggaaccaaacgtacggtacctaaccggttacgaacccgtaacgtacggtaacggttacgggtaaccggtaacccggaagggtaaccgaaacggggaaaaccgggtaaccgggtaacggggtaccgttaaccggtaaaccgtttaaccgttacccgtaaccgtttacggtaaaccgtaaaacgtttaaccgaaccgttaaacggaaaccgtaaacggtaaccggtaaaacggttaaccgggaaaccccgttaaagggtaaccgggggttaccggttacggggtttaccgggggtttacgggggttaacccgggggtaacgggggtaaacccgggggtaaccccggtaaaccgggtacccggtttaaacccgggttaaacccccgggtttaacccggttaaaaccgggttacccggaaaacccccggggtaccccggtaaaaccccgggg

SEQ ID NO: 102911 - DNA, 513 bp, Homo sapiens
  misc_feature: GYAE6OF01DVZVL.3.34.D01.1.454.CMB.1.raw
  modified_base (366)..(366): a, c, t, g, unknown or other
  misc_feature (366)..(366): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtggagatgcattggacaaagctatatgcttactggtaccagcagaagccaggccaggcccctgtggtggtgatataataaagaccgtgagacggccctcgagggactcccgtgacgcgaatctcgtgcctcgagctcgaggacaacngtcacgttagaccatcgagtggacgtcgaggacaagaagacgaggctagactagtcagtgtaacaatgacagacagacaagacgaccagtaggctggtggttggtcgggaggagggacagcgtacgacgtacagcacgcccgtacgg

SEQ ID NO: 102912 - DNA, 724 bp, Homo sapiens
  misc_feature: GYAE6OF01BM0SS.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtggagatgctattggacaaagtctatagtgcttacgtggtaccagcaagaacgccacggccacggcccctggtggtggtagattataagtaaacgaccgtagacggacggccctacgaacgggtactcccgtaggacgacgtaacgttccgtcgtacgggccttaccgacggtccgtacggaacgggaacctaaacggtacgttaccgtaaacgtttcgaaaccctagttacggaacggttagggaaccgttaccgaggaccgaaggaacggaacggacggtacgtagtaactacgtacgaacgttagaactaaacgtaacgacgaagtaccaagtacgaaacgtaccggaacccgtaaggttacgggtccgttaggggttaccgggttcggggttaacccgggggacggggaaccgggtaaacccggtaaacggtccgttaaccgggtaaccccggttaacgtaaaccgggtaccgaaacccgggtaaccccggtaaacccgggg

SEQ ID NO: 102913 - DNA, 712 bp, Homo sapiens
  misc_feature: GYAE6OF01A53S1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtacccaggacagacggccaggactcacctgctcgtggagatgcattggactaaagctatatgacttacgtggtaccagcagaacgccaggccgacggcccctggtcgggtggtagtacttaagtaacgtaaaacggtaccgttaggaacggtaaccgggtccccgttacggaacgggggtaccttcccccgttaggaaccggtaccggtaaacttccgtccgtcgggaccttccgacggtcctacggaacggggaacctaaacgtacggttaccgtacggtttacgaacctagttacgaaggttacgggaacgtaccgaacgggacgaaggaaacggacggaacggtcgttagaaccttacgtacgacgttacgaaactaagtacgaacgacgtacgaacgacgtaacgtaccggaacctaggtacgggtcttagggtcgggttcgggtaccggggacgggaacgggtaaccgtaacggtcggtaaccgtaccggttacggtaagtccgaaccggaccggtaaccgg

SEQ ID NO: 102914 - DNA, 763 bp, Homo sapiens
  misc_feature: GYAE6OF01DWUBL.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacgaggctctgacggcctcctatgagctgaccacacgccctacccgtcggtgtcgtagtcgtaccccgaggacgacggaccggccaggactccactgctcgtggagatgactagttaggacaaagtctatacgtgtacttacgtacggtaccagacaagacgccgacggccgacggtccccgtaggtgggtaggtagtaattaagtaagtaaacggtaccggtaggacggaccggtcccgtacggaacgggtaccttacccggaggacggtaccgtaacttccgtaccgtcggtacctccgtacgccgtacggaacgggaacaacggtacgttacccgtaacggttagaaccctacgtacggtacgggtacgggtaaccgtacggagggtaacgaaagggaaacggacggtaaccgtagtaacggaacttactaccgtaacgtactaacgaaagtaccggaactaacggtaaccgaagaaccgtaaacggtaccggtaaaccgtaggtaggtacggttagggttacggggttacgggtaccgggggaccgggtaaccggtaacccggtacggtacccggtaccggtaccccggttacaaacggtccgaaccgaccccgggtaacccgg

SEQ ID NO: 102915 - DNA, 547 bp, Homo sapiens
  misc_feature: GYAE6OF01A7MJ1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacttgctctggagatgcattggacaaagctatatgcttactggtaccagcagaagccaggccaggcccctgtggtggtgatataataaagaccgtgagaggccctagagggatccccgtgagcgaatctcgtggctccagctcgagggacaacagtcacgttgaccatcgagtggagtccgaggacaaggaagacgagggctagaactatacactgtacaaagtagacagaacagacaagtacggaacccagtacgggtctggtgggttggttcgggacgggacgggaccgaaggccgtacggtacccgtacgtaacggtcgacggcccgtaaccggg

SEQ ID NO: 102916 - DNA, 820 bp, Homo sapiens
  misc_feature: GYAE6OF01BYPDK.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctggaggccctcctatgagctgacacacgcccacccgtcggtgtcagtcgtccccaggacaggacggccaggactccactgctcgtggagatcgctagttggacaaagtctatatgtacttacgtcggtaccagacgaagaacgccgacggccgaccggtccccgttgggtcgggttaggtaggtaattaagtaaaggtaaaacggtaccggtaggaacggaaccggcccgttaaggacggggtacctccccggtaggaacggtacgtaaacgttccgttaccggtcgggtacccttacccgacgtacccgttaccggaacgggggtaaaccctaaacggtaacgttacccgtaacggtttaccgaacctacgttacgtaacgggtacgggtaaccgtaccgagggtaaccgaacggaaacggaccggtaacggtaccgtagtaaccgtacgtaccgtaagttacgtaaactaacggtaacgaaccgtaacggaacgtacggaaacgtaacggtaccggtaaacccggtaaggttaccgggtacgtttaggggtacggggtttacgggtaccgggggtaacggggtaaccgggtaaaccggaaccggttaccggtaaccgggttaccccggttaacgtaaaaccgggttccgaacccgggaaccccggttaaacccggg

SEQ ID NO: 102917 - DNA, 797 bp, Homo sapiens
  misc_feature: GYAE6OF01CDMVO.3.34.D01.1.454.CMB.1.raw
  modified_base (226)..(226): a, c, t, g, unknown or other
  misc_feature (226)..(226): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtgganatgcagttggacaaagcttagtatgtacttacgtacggtaccagcaagaacgccgacggaccgacggtccccgttggtggtggtagattataagtaaacgaccgtagagacggccctagacggtctcccgtaggacgacgaactcgtacgtcggtctccgagtccgtacgaagggaacccaacgtacggtaccgtacgttaccgaaccgtacgttacgacgggtttaggaaccggttacccgaagggtaccgaaagggtaaaccgggaaccgggtaagggtaccgttacggaaccgttaccgttaaccgtaacgttacggtttaaaccgaaaagtaccgaacgtaacgaaaccgtaacgaaccgttaaaacggttacccggaaacccgttaaggtaccggggttaccgttaggggttttaccggggttacgggtttacccgggggtaaccgggggaaaccggggtaaaccccgaaaccgggttacccgggttaaaccggggtaccccccggtttaaccggtaaaccgggtttaccccgaaccccggggtaaccccccggttaaacccgggg

SEQ ID NO: 102918 - DNA, 516 bp, Homo sapiens
  misc_feature: GYAE6OF01BN5DE.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggcccctacagggtatccctgacgcgaatctctggctcagctcgagggacaacagtcacgttgaccatcagtggagtccaggacagaagacgaggctagactatcactgtacaaatagacaggaccagacaatcggaacccataagggcttaggtggtgttacgggcggagggaccaaggctagaccgtacgtaagcgagcccgtaacgg

SEQ ID NO: 102919 - DNA, 490 bp, Homo sapiens
  misc_feature: GYAE6OF01EEQFA.3.34.D01.1.454.CMB.1.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattggcaaagctanatgcttactggtaccagcagaagccaggccaggcccctgtggtggtgatatataaagaccgtgagaggcctcagggatccctgagcgaatctctggctccagctcagggacaacagtcaacgttgaccatcagtggagtccaggacagagacgagctgactatcactgtnaaatagcagacagcaatggaacccagtaaggntgtggtggttcggnggagggcagctgaccgtacaagtcagcccgaacgg

SEQ ID NO: 102920 - DNA, 752 bp, Homo sapiens
  misc_feature: GYAE6OF01B9YUP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgaccaggatcacctgctctggagatgcattggacaaagctatatgcttactggtaccagacaagaacgccaggccacggcccctgtgggtggtgatagtaataaagaccgtgagacggccctacgagggactcccgtaggacgacgtaaactccgtacgttcggccttcccgaagtcctacggaacggggtaacccaaaacgtacggttaccgtaaccggtttacggaaccctaacgttaccgtaagggttacgggtaaccggttacccgaacgggaccgaaagggaaacggaccgggtaacgggtaccgtagtaaccgttaacttaccgtaacgttacgttaaaccaaagttaacgaacgtaacgtaacgaacggtaaccaaaggttaccggaaacccgtaaggtacggggtacgttacgggttaggggtttcgggtttaccgggggaccggggaacgggggtaaacccgaaccgggtaccggtaccgggtaaacccccggttaaccgttaaaccgggtacccgaaccgggttaacccccgaaacccggggg

SEQ ID NO: 102921 - DNA, 654 bp, Homo sapiens
  misc_feature: GYAE6OF01BBGBP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattggacaaagctatatgacttactggtaccagacaagaacgccaggccacggcccctggtggtggtgtataagtaataaacggaccgtagaacggacggcccgtacgaacgggtactccccgtaggacgacgtaactccgtacgtcggcctccgacgtctacgacgggaacaacgacgtcacgttacgacctatacgtaggtggacgtaccgaggacgaaggaaacgacggaggactagtaacctagtacctacgtacgtaactaaagtcgactaacgaacgaacgacaaacgtaccggaacctaaggtacgggacgttagggttacgggtacgggttccggggacgggaacggggtaacccgaaggtccgttaacccggtaacccggttacccgtaaaggccgtaaacccggcccgtaaccggg

SEQ ID NO: 102922 - DNA, 788 bp, Homo sapiens
  misc_feature: GYAE6OF01BMYUK.3.34.D01.1.454.CMB.1.raw
  modified_base (222)..(222): a, c, t, g, unknown or other
  misc_feature (222)..(222): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcagttggacaaagctatatgcttacgtggtaccagcagaacgcgagccacggcccctggtggtggtgatataataaagacgtgagacggccctcgagggactcccgtaggacgacgaactcgtacgtcggcctaccgagtccgtacggaacgggaacctaaacgtacggtaccgtaaaccgtttacgaaccctaacggttacgacgggttacggggaaccgttacccgggaagggaaccgaaacgggaaacggtaacccgggaacgggtaccgttaacggtaaccttaacgtacctaaacggtttacgtaaaccgtaaaacgtaacgaccgaaacggaaccgtaaacgaaccgttaaaacgttaacccggggaaaaccctagggttaaccggggttaccgttacggggttttacgggggttaccggggtttcccgggggtaacccgggggaaaccgggggttaaacccggaaaccgggtaccccggttaaccgggtaaccccgggtttaacccggtaaaacccggtttccggaaaaccccggtacccccgggtaaaaccgggg

SEQ ID NO: 102923 - DNA, 797 bp, Homo sapiens
  misc_feature: GYAE6OF01BFNFG.3.34.D01.1.454.CMB.1.raw
  modified_base (133)..(133): a, c, t, g, unknown or other
  misc_feature (133)..(133): n is a, c, g, or t
tcagagacgcactccacgaccggtgctcgatttagatcgtctgtgttgggtttgggggtgggtaccgaggaggcagaactcgtgggtgtcctcaccatggcctggattccctcgtaccttcctcccctcctcnctcgtctgcacaggctctggacggcctcctatgagtctagacacacgcctacccgtggtcgtacacgtccgtaccccaggaccaggaccggccgaaggtctcctaccgttggactcggtaggagtcgtcgactaagttcggaacgtaaacggtcctaagtacgtacggttacccttaacggttaccggtaaccaggtaaccgtaaaggttaacggacccggtaggtaccccggacggtccccggttaggggtaggttacggtaataaccgttaagttaaacgaaacggtccgtaagggtaccggaccggtccgtacggagggtacccctccgtagacgactacgtcgttacgcggacctcgagtaccgacggaacggtaccgtaacgtggtaccgtacggtactactacgtcggtagtacggacgcgtagacggaagaacgacggacgtacgtacgtaacgtactacgtagttaccttaaagaacgttaccgaacgtaaacgacgaaggtaacccttaaggaacccggtaacctacggttacgggtaccgttttagggttacgggaaccgggttcgggaacccgggttaacggtaacccggtacggtaccggttacccggtaaacccgttaggaacccgtccggaaacccgttcccggtaaccg

SEQ ID NO: 102924 - DNA, 617 bp, Homo sapiens
  misc_feature: GYAE6OF01B3OTF.3.34.D01.1.454.CMB.1.raw
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (438)..(438): a, c, t, g, unknown or other
  misc_feature (438)..(438): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtcccctaggacagacggccaggatcacctgctctggagatgcattggcaaagctatatgcttactggtaccagcagaagccaggccacggcccctggtggtggtgactataataaaacggaccgtagagacggccctcgaagggactccccgtggaagcgtaaactctcgtggctccagctacagggacaaacngtacacgttnaccattcgagtaggacgtaccgaggcaagaagacgaggctagaactanaccgtactgtacctaaagagtacaagacaaggacaaagtaccgggaaccctaagtacgggacgttcggttagggttcgggttaccggggtaggggaacggggtaaccccgaaagggtcccgtaacggtaacccggttaacccgttaaggttacccgaccggaacccccggtaaaccggg

SEQ ID NO: 102925 - DNA, 740 bp, Homo sapiens
  misc_feature: GYAE6OF01CY20A.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggccctcctatgagctgacacagcccaccctggtgtcagtcgtccccaggacagacggccaggactcacctgctctggagatgcagttggacaaagctatatgtacttacgtacggtaccagcaagaacgccgacggccgaacggtccccccgttgggtgggttcgggtagtaagttaacttaagtaaaacggaccggtggaacggaccgggtccccgttacggacgggtacctcccccgtaggaacgaccgaaacgttccgttccgtcggtacccttccgacgtccgtacggtaacgggaacaaacgtacgtacgtaccgttacgacctacgttacgaggtaggtacgtaccgaaggtacgaaaggaaacggacggaggtccgtaagaccgtaacttacctaacgtcgtaaactaaacgtacgacgtaacgaacgaacgaacaaacggtaaccggaaccctaaggtaacgggtcgttacgggttaggggttaccgggttccgggggaacgggtaaccgggaacccgaacgggtcggtaaccggtaccccggttaaaccgttacggtaaccgacccggtaacccggtaacccggg

SEQ ID NO: 102926 - DNA, 826 bp, Homo sapiens
  misc_feature: GYAE6OF01DC0LG.3.34.D01.1.454.CMB.1.raw
tcagagacgcactccacgaccggtgctcgatttagatcgtctgtgttgggtttgggggtgggtccaggaggcagaactctgggtgtctcaccatggcctggatcctctacttctcccctcctcactctctgcacaggctctgaggcctcctatgagctgacacagcccacccgtcggtgcagtcgtacccaggacaggaccggccgaggactcaccgtgctcgtggagatgctagttcggacaaaagtctaatattgtacctttacgtacggtaccaggcaaaggaacgcccgaacgggtcccgaccggtccccgttggttcggggtaggtagtaatttaagtaaaacgttaaacggaccggtaggaacgggaccgtccccgttaggaacgggtccttacccggaggaacgtacgtaacgtttccgtacgttcggaccgttaccgacgtccgtaacgggaacggaaacctaacgtaacggttcccgtaacggtttacaacccgtaagttcgtaacggggtcggtaaccggtacggaacgggtaacgaaacgggaaacggtccgggaacgtccggttaacggtaaacctttacgtaccgtaacgttacggttaaaacaaggttaccgaaccgtaggaaacctacggaaacgaaacgttacgggaacccgttaggtaaaccgggtggttacgggtttgggtaaccgggggtttacggggaacccggggtaaacgggtaacccggtaacgggtacccggttaaaccggttacccccggggttaaacgttaaaccgggccccgtaaacggggtaccccgttaacccgggg

SEQ ID NO: 102927 - DNA, 817 bp, Homo sapiens
  misc_feature: GYAE6OF01B582M.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctcgtggagtatgcattggactaaagctatatgacttactggtaccagcagagccgagccgacggtcccctggtacggtggtagacttaataagtaaacggaccgtaggaacgacggtaccctacggagggtactcccgtaggacggacggtaacttccgtacggttcgggaccccttaccgaacgtccgttaaccggaacggggtaaaccaaacggtacggtaaccgtaaccgtttacggaaccctaagttaccggtaacggttacggggtaaccgttacccgggaaagggtacccgtaaacggggaaacgggaacccgggtaacgggtacccgtttaacgggtaaacctttaaccgtaaccgtaccggtttaaggtaaacccgaaaagttaccgggaaaccgtaacggaaaccgtaaacgggaaccgtaaaacgggtaacccgggtaaacccctaagggtaaccggggttaccgttacggggtttaaccgggggtacggggtttacccggggaaccggggaaccggggtaaaccgaacggtcccgtaacggtaaccccggttaccgtaaacgtaccggaaccgtacccggaaacccggg

SEQ ID NO: 102928 - DNA, 665 bp, Homo sapiens
  misc_feature: GYAE6OF01CQ1A0.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggccctcctatgagctgacacagccaccctcggtgtcagtcgtccccaggacagacggccaggactccacctgctcgnggttagatgcagttggacaaagctatatgtcttacgtcggtaccagacagaacgccgacggccgacggcccctggtgggtcggtgatagtaagtaaacgaccgtggaggacggcccgtacgacgggtactccgtgacgacgaatctcgtcggcctaccgagtccgtacgaacgggacaacgtacgtacgtacgttacgacctagtcgaggtggtacgtccgaaggacgaaggaaacggtacggacggtacgtaggtaacctacgtaccgtaacgtaggtaacctaaagtacgacgaagaccgagacgtaacgtaaccggaccgtaaggtacgggtcgttacgggttagggttccgggttcgggacggggaacgggaccgtaacgggtacccgtaccgggtacccgtaccgtaacgtaccgaccggtaccccggtaacccggg

SEQ ID NO: 102929 - DNA, 725 bp, Homo sapiens
  misc_feature: GYAE6OF01EM0V5.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtcccaggacagacggccaggatcacctgctctgganagtgctagttcggacaaaagtctaagtaatgtacttaacgtaggtaaccagaccaagaacgccacggaccacggcccctggtggtggtagattaagtaagtaaaacggacccggtaggaacggaccgggtacccctacggaacggggaccttaccccggtaggaacggaccgtaaacgttccgttacgtcggggtacctacccgaggtcccgttacggaacggggaaaccctaaacgtacggtacctaacggtttacgaacctagtacgtaagggtacggtacaaccgaaagacgaaggaaacggaccggaggtactacgtacttaactcgtaacgtacgtaacaaacgtcgaacacggaacgtacgaacaacggtaacggaaccctaagggtaacgggtcgttaggggtcggttacgggttcggggaaccgggtacgggtaaccgaacggtcgtaaccggtacccgttacgtaaaggtcccgaacgtacccggtaaaccgg

SEQ ID NO: 102930 - DNA, 719 bp, Homo sapiens
  misc_feature: GYAE6OF01A89RI.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggccctcctatgagctgacacagccaccctcggtgtcagtgtccccaggacagacggccaggatcgacctgctcgtggagatgcagttggacaaagctaatatgacttacgtcggtaccagacaaggaacgccaggccacggccccgtgtcggtggtgatagtaataaacggccgtgaggacggtccctagacgggtactcccgtagacgacgtaaactcttacgtcggcctccgagtccttacggaacgggtaaccaaacgtacgttaccgaacggtttacgaacctagtacgtacgggttaggaacgttcccggaaggaccgaaaggaaacggaacggacggtactacggtaaccttaacggacctaacgttacgtaaaccgtaaagttacgaacgaaacgaaccgtaaggaactaaacggtaaccgggaaaccgttaaggtacgggtacggttagggtagggtttccggtaacgggggtacggggaaccgggtaaaccgtaacgggtccgttaaccgggtaccccggttaacgttaaaccggtaccgaaaccggtaccccggtaaaccggg

SEQ ID NO: 102931 - DNA, 883 bp, Homo sapiens
  misc_feature: GYAE6OF01BHB61.3.34.D01.1.454.CMB.1.raw
  modified_base (180)..(180): a, c, t, g, unknown or other
  misc_feature (180)..(180): n is a, c, g, or t
tcagagacgcactccacgaccggtgctcgatttagatcgtctgtgttgggtttgggggtgggtccaggaggcagaactctgggtgtctcgccatggcctggatccctctacttctcccctcctcactctctgcacaggctctgaggcctcctatgagctgacacacgccacccgtcggtntcagtcgtccccgaggacagaccggccaggactccacctgctcgtggagactcgactagttcggacaaaagcttaatacgtcgttaccgttacgtacggtaaccgtacgaacgaacggaaccgaccggaccggtacccggtacccggttccggttagggttaggggtacggtaagttaacgttaaacggtaaaacggtaaaccggtacggtacggacgggtacccgtaccgtaacgggtaacggtacccttacggacggtaaccgtaccgtaacgttccgttacgtccgtacccgtactacggtacctaacgggaacgtaaacgaacgttacgtaccgttaacggaccgtaacgtaacgtcggttaacgggacggtaacgacggtaggaaacggtaacggaacggaacggtacgtaccgttaagaccgtttacgtaccgtaacgttaagtaacaaaggtccgtaaggaaacccggtaacgtaaccggttaaacgtaacccgggtaaacccggtaaccggtaacgggttcggggttaccgttttacgggggttaaccggggtttacccggggaacgggggttaaccgggaaaccccgggttaaacgaccccgggtttaaccggtaaaccccccggggtttaacccggttaaccgttaaacccggcccggggtaaaccccccgggtacgggttaacccccccggg

SEQ ID NO: 102932 - DNA, 633 bp, Homo sapiens
  misc_feature: GYAE6OF01DLTK5.3.34.D01.1.454.CMB.1.raw
  modified_base (395)..(395): a, c, t, g, unknown or other
  misc_feature (395)..(395): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggacaaagctatatgtcttactggtaccagcagaagccaggccaggcccctgtggtggtgatataataaagaccgtgagacggccctcgaagggactcccgtgacgacgtaactcttcgtaggctccgaagtcctcgaagggtaccaacgtagtcctaacgggttanaacccgtagttccaaggttacggacgtaccgaaggacaaggaaaggacggaaggctacggtaactataccacgtagtacaaattaagcaagactaagactaaacgtaggaacccgtagtaacgggtactcgggtttcgggtgggttacccggggacggggtaacggggaaacccgtaaggtcccgtaccggtaaccggttaccgtaaccggttacgaaccgggtccccggtaaacggg

SEQ ID NO: 102933 - DNA, 776 bp, Homo sapiens
  misc_feature: GYAE6OF01BE4LG.3.34.D01.1.454.CMB.1.raw
  modified_base (225)..(225): a, c, t, g, unknown or other
  misc_feature (225)..(225): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgcagttggacaaagctatatgtacttactggtacagacagaacgccgaggccacggcccctggtcggtggtagaattagtaataaacggtaccgtagaggacggccctacggaagggactcccgtagacgcgtaagtctcgtacggcctcgacgtcgtaccgaagggaaccaaacgtacgtaccgtaacgttacgaaccctagtcgtacgggttacggaacgttccggaaacgggacgaaacgggaaaacggtaccgggaacgggtaccgttaacggtaaccgtttaaactaacccgtaactttaacggtaaacctaaaacgtaacggaaccaaacggtaaccgtaaaccggtaaccgtaaaacgttaacccggggaaaccccgtaagggttaaaccggggtccggtttagggttaacgggggtttaccgggttaaccgggggtaaccgggggaaccgggtaacccgggtaaacgtcccgggttaaacccggttaaccccggttaacggtaaaccgtcccggaaacccggtacccccgggtaaacccgg

SEQ ID NO: 102934 - DNA, 637 bp, Homo sapiens
  misc_feature: GYAE6OF01E2N3J.3.34.D01.1.454.CMB.1.raw
  modified_base (223)..(223): a, c, t, g, unknown or other
  misc_feature (223)..(223): n is a, c, g, or t
  modified_base (324)..(324): a, c, t, g, unknown or other
  misc_feature (324)..(324): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccacccgtggtgtcagtcgtccccaggacagaccggccaggatcacctgctctggantgcattggacaaagctatatgcttactggtaccagcaagagccaggccacggcccctgtggtgtgatatataaagaccgtgagacgcctgagggatcccgngacgcgaatctcgcggtctccgagctcgaagggacaacgtagtcctacggttcgaacctatacgtaggtcggaacgtcccgaagggtaccgaaggtaaacgaaccggggaagccgttagaaacctataccgtaactacgtaacaaaatcgacgagaacgaagacctaaagtacgggaaaccctaggtacgggtacttcggggtacggtttcgggttccgggacggggtaaacgggtacccgaaagggtcccgttaaccgggtaaccccggtacttaaaacccgggcgtaaacccgggtcccggtaaacccggg

SEQ ID NO: 102935 - DNA, 656 bp, Homo sapiens
  misc_feature: GYAE6OF01CMQTK.3.34.D01.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgacggcctcctatgagctgacacacgccaccctggtgtcagtcgtccccaggacaggacggccaggatcacctgctcgtggagatgcagttggacaaagctaatatgctttacnggtaccagcaagaacnccgaggccaggccctgnggtgngatataataaagcgtagagacggccctagagggactcccgagagacgtaaactcgtactcggctccgaagcctacgaacgggaacaaacgtacggttacaacggtttacggaaccctaagttaccaagggtcggaacgtcccgaaggaccgaaggtaaacggaacggaggtacctaggtaactaacgtactaacgtaggtaaaccaaagttacgacgaagaaccgagaacaaagtacgggaaaccctagtaacgggtcgttacgggttgggttacgggttcggggacgggtaacgggaaccgaacggtaccggttacggaacccgttacggttaacgacccgaaggccccgtaaaccgggg

SEQ ID NO: 102936 - DNA, 757 bp, Homo sapiens
  misc_feature: GYAE6OF01AO8N9.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacagaccggccaggactcacctgctcgtggagatgctagttggacaaagctatatgtcttacgtggtaccagcaaggacgaccgacggccacgggtcccctggttgggtcggtagtattaagtaagtaaacggtaccggtaggaacggacggtccctacgacgggtacctcccgtaggacgtacgtaactcctacgtcgggtccctaccgacgtacgtacgaacgggtaacccaacgtacgtacgtaaccggtttacggaacctataccggtaacggttacgggtacgtacccggaaggacggtaaaggaacggaacgggacggtacgtacgtaactacggtactaacccgtagtaaccaaagtacgaacgacgaacgtacgaactaacggtaaccggaacccgtaaggtaacgggtcgtttacggggttacgggtttaccgggggttacgggaacccggggtaacgggtaaacccgggtaacggtacccggttacccgggtaaacccggtttacccggaaacgggttaccccgaaacccggtaaccccgggtaaacccgg

SEQ ID NO: 102937 - DNA, 632 bp, Homo sapiens
  misc_feature: GYAE6OF01CR5JR.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgtcttactggtaccagacagaacgccaggccacggcccctggtggtggtgaatataagtaaacgaccgtgaggacgtccctacgagggactcccgtggacgacgtaactcgtcgtcggacctccgacgtctacgaacgggaacaagacgtacgtaccgttgacctatacgagtacgggacgtaccgaggtaccgaaggaaacgacggacgacgtacggtaactactactacgtacgtaacgaagtacgacgaacgtaacgagaactaaacgtacgaacccgtaaggtacgggtgtaggttcgggtacgggttcgggaccgggtaacgggaaccacgggtacgtaccgggtaacccgtaccggtaacgtaccgaccgtacccgtaaccgg

SEQ ID NO: 102938 - DNA, 605 bp, Homo sapiens
  misc_feature: GYAE6OF01DUSD2.3.34.D01.1.454.CMB.1.raw
  modified_base (347)..(347): a, c, t, g, unknown or other
  misc_feature (347)..(347): n is a, c, g, or t
  modified_base (458)..(458): a, c, t, g, unknown or other
  misc_feature (458)..(458): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgtcttactggtaccagcagaagccaggccaggcccctgtggtggtgatatataaagacgtgagacggcctgaggctcccgtgagacgaatctctggcctccganctacgaacgggacaaacgacgtacctacggttacgacctagtaccgaggttagggacgtacccgagggaccaaggaaacgacggaggactgtactagtctacgtacgtaanaaatacgacaagaacgagaccaaagtaccggaacccaggtaacgggtcgttgggttagggtcggttacggggacgggtaacggggtaaccgaacggtcgtaaccggtacccgttaacccgaagttacccgacggtacccgaaacggg

SEQ ID NO: 102939 - DNA, 715 bp, Homo sapiens
  misc_feature: GYAE6OF01CHZDV.3.34.D01.1.454.CMB.1.raw
  modified_base (245)..(245): a, c, t, g, unknown or other
  misc_feature (245)..(245): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccacccgtcggtgtcagtcgtccccaggacagacggccaggatccacctgctctggagatgcattggacaaagctatangcttactggtaccagacaagaacgccaggccacggcccctggtgggtggtgatataataaagaccgtagacggaggccctgaagggctcccgtgacgacgtaactccgtcgtcggctccgaggtcctacgaacggggacaaacgtacgtaccgtaacgtttacgaacccgtataccgtaagggtacggtaacggtacccggaaggaccgaaacgggaaacggaacccgggtaagggtaccgtaaggtaaccgtttaacgcctaaaccggttagtaaacaaaacgttacgaaccgaaggaacctaacggaccgtaaacgttacgggaaaccccgtaaggttaccggggtacttaggggttacgggttacgggttaccgggggacggggtaaaccggggaccaaacgggtaccgttacgggtaacccggttacccgttaaacgggcccgtaaccggacccggtaaacccggg

SEQ ID NO: 102940 - DNA, 681 bp, Homo sapiens
  misc_feature: GYAE6OF01CTL9M.3.34.D01.1.454.CMB.1.raw
  modified_base (226)..(226): a, c, t, g, unknown or other
  misc_feature (226)..(226): n is a, c, g, or t
tcagagacgcactccacgaccggtgctcgatttagatcgtctgtgttgggtttgggggtgggtccaggaggcagaactctgggtgtctcaccatggcctggactccctctacttctcccctctcactctctgcacaggctctgacggtcctctatgagctgacacacgccacccgtggtgtcagtcgtcccgaggacagacggccaggactcacgtgctcgtgganatgactagttcggacaaagtctatactgtacttacgtaggtaccagtacaagaacgccgaacggccacgggtcccctggtggtcggtagaattaagtaagtaaaacgtaccggtaggaaggtaccggaccccgtacggaaacgggtacctcccgtaggacgtacgtaactccgtcgtacggccttacgacgtccgtagacgggaaccaagtacgtactacgtacgactagtccgagttacggactacgaggacgtaaggaacgacggacgacgtacgtaactatacgtaacgttacgaaactaacggtataacgaacgtaaacgacgtaacaagggttacgaacccgtaaggtacggttcgtaggtacgggtcgggttaccgggaagggtacgggtaaccaacgggtacttcggtaaacccggtactaacggttacgaccggtaccgaacccggg

SEQ ID NO: 102941 - DNA, 820 bp, Homo sapiens
  misc_feature: GYAE6OF01DYMPZ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccacctcggtgtcagtgtcccaggacagacggccaggatcacctgctcgtggagatgctattggacaaagctatatgactttacgtggtaccagtacgaagtaacgccgacggaccacggcccctggttgggtaggtcgtaataagttaaataaaacggacccggtaggaaggacggcccctacggaacggggtacctcccgtagaacggtaccgtaacgtcgtcgtacggacccttcgaacggtccgtacgaacggggaacaaaccgtaggtacccgtaacggtttacgaacccgtaacgttacgtaacggttacgggtaaccgttacccgggaagggtaaccgaaacgggtaaaacggaccgggaacgggttacccgttaacgggtaaacctttaacggttaccgaaacccgttagggtaaccctaaaaaggtacccggacgaaacggaaccgaacggaacccgtaaaacgttacccggggaaaccctaagggttacggggtacccgttaggggtttaccgggttaacgggttacccgggggaggggtaaacccgggggtaaaccaaacgggtccgttaaccccggggaaaaccccgttttaacccgtaaaccgggttacccgtaacccgaacccccggttaaacccggggg

SEQ ID NO: 102942 - DNA, 533 bp, Homo sapiens
  misc_feature: GYAE6OF01B9AGS.3.34.D01.1.454.CMB.1.raw
  modified_base (419)..(419): a, c, t, g, unknown or other
  misc_feature (419)..(419): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattggacaaagctatatgcttactggtaccagcagaagccaggccaggcccctggtggtggtgatatataaagaccgtgagaggccctcgagggactccctgagcgaatctcgtgctcagctcgagggacaacgagtcacgttcgaccagtcaggtggacgtcaggacagaagacggagctgactatcactntacaagtgacagacagacaagtacggaacccagtacgggctggtaggtcggtcgggacgggacgggaccaaggcgtacggtaccgtaccgtaagtccaacggcccgtaaccggg

SEQ ID NO: 102943 - DNA, 680 bp, Homo sapiens
  misc_feature: GYAE6OF01DFXB7.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggccctcctatgagctgacacagccaccctcggtgtcagtcgtccccaggacagacggccaggatccacctgctcgtggagatgctagttggacaaagctatatgtacttacgtaggtaccagacgaagaacgccgacggcccgacggtccccgtggtgggtggtagaattaagtaagtaaacggaccggtaggacggaccggtccctacggacgggtacctacccgtaggacgacgtaacttcgtccgtcggtcctaccgacgtccgtacggaacgggaaccaacgtacgtaccgtacgtacaccgatacgaggtacggacgtaccgaggacgaaggaaacgacggagtcgtagactactacgacgttagaactaagtacgacgtaacgaacgacgaacgtaacgtaaccggaacccgtaaggtaccgggtgttagggttcgggtacgggttcgggaacggggaaccgggaccgaacgggtccgtaaccggtacccggttaacgtaacggtaccgaccggaccccggtaaccggg

SEQ ID NO: 102944 - DNA, 518 bp, Homo sapiens
  misc_feature: GYAE6OF01A0L9Q.3.34.D01.1.454.CMB.1.raw
  modified_base (356)..(356): a, c, t, g, unknown or other
  misc_feature (356)..(356): n is a, c, g, or t
  modified_base (460)..(460): a, c, t, g, unknown or other
  misc_feature (460)..(460): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgggcaaagctatatgcttactggtaccagcagaagccaggccaggcccctgtggtggtgatatataaagccgtgagaggccctcagggatccctgagcgaatctctggctccagctcagggacaacngtcacgttgaccatcagtgacgtcaggcaggaagacgaggctggactatcactgtcaaatgcagacagacaaagtcggacccagtgggctggtggtgttcgggnggaacgggaccaaggtccgtagacccggttaccaagttccgaaggccccgtaaacggg

SEQ ID NO: 102945 - DNA, 734 bp, Homo sapiens
  misc_feature: GYAE6OF01B3FVV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggactcacctgctcgtggagatgacagttggacaaagtctatacgtgtacttacgtcggtaaccagacgaagaacgaccgacggccgaccggtccccgttgggtcgggttgggtagaagttaataaacgtaaaacggtacccggtaggaacggaccggtcccgtaggtacgggtacctccgtaggacggtcggtaaacttccgtacgtcgggtaccctaccgacgtaccgtacggaaacggggaacctaaacggtacgttaaccggtaaccggtttacgaaccctacgtacggtaacgggttacgggaacgtacccggacggtaacgaagggtaaacgaacggacggtcgtaacgaactacgtacgtaacgtataaccgaataacggacaacgacgtaacgaacgtaacgtaccgggaaaccaggtacgggtcggttaggttacgggttcgggtacggggacggaaccggggtacgtacgtaccggtacggtaccgtaccggtaacgacgaacccggtccgtaacccgg

SEQ ID NO: 102946 - DNA, 669 bp, Homo sapiens
  misc_feature: GYAE6OF01D6Q7J.3.34.D01.1.454.CMB.1.raw
  modified_base (250)..(250): a, c, t, g, unknown or other
  misc_feature (250)..(250): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctctatgagctgacacacgcccaccgtcggtgtcacgtcgtccccaaggacgaggacggccaggactcaccgtgctcgtggagtatgctagttggacaaagntatatgtacgttacgtacggaccagacaagaacgcgacggccacggcctggtggtgtagattaagtaacgaaacggtccgaggaacgacggtccagacgggtacttcccgaggacgacggtaatcgtagcggtactccgagcgtacggaaacggactaaacgtaagcgtaacgttacgaaccgtagtaccggtaggtacggtacggtacgaacgggacaaagggaacggtaacggaacgtacgtacggtaacttaacgacgtaacgttagtaactaaaacggaccgtagaaacgaacgaacgaacgttaacgaacggaacctaaggacggtacgtggtacggttacggggtcggacgggtaacggaccgttagacccggttacggtacccgtacgacgtacgacccgtaccgtaaccgg

SEQ ID NO: 102947 - DNA, 522 bp, Homo sapiens
  misc_feature: GYAE6OF01A6383.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagacggccctcgagggactcccgtgagcgaatctctggctccagctcgagggacaacagtcacgttgaccatcagtggagtccgaggcaaggaacgacgaggctgactatcactgtacaaatgacagacagacaagtacggaacccagtacggctggtggtggttcgggagggacggaccagctacggtacccgtacctaagtccaggcccgtaacggg

SEQ ID NO: 102948 - DNA, 632 bp, Homo sapiens
  misc_feature: GYAE6OF01CBSOE.3.34.D01.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
tcagagacgcactccacgaccggtgctcgatttagatcgtctgtgttgggtttgggggtgggtccaggaggcagaactctgggtgtctcacatggcctggatccctctacttctcccctcctcactctctgcacaggctctgacggcctcctatgagctgacacacgccaccctggtgtcagtcgtcccaggacagacggcaggatccacctgctctgganatcgnattggacaaagctatatgtcttacgtgtaccagacgagaacgccgacggccacggtccccgtggtggtggtagaacttagtaaagtaaacgaccggtagaggacggcctaggaggtactccgtagacgacgatcgtacgtacggcctacgacgtacgtacggaacggacaacgtcgtacgtacgttacgactagtacgacggtacggaacgtccgaagacgtaagaacggacgtcggtactacgaactactactaactacggtaacaagtcgtaacaacgaacgtagaaccgtaacgtaccgggaaaccctaggtacggtcgttacgggtacgggtcgtacggggacgggtaacggaccgtaaggtcgtaccgtacccgtaactaggtccgaacgtcccggtacgg

SEQ ID NO: 102949 - DNA, 663 bp, Homo sapiens
  misc_feature: GYAE6OF01C9J54.3.34.D01.1.454.CMB.1.raw
  modified_base (328)..(328): a, c, t, g, unknown or other
  misc_feature (328)..(328): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgcattggacaaagctatatgcttactggtaccagcagaagccaggccaggcccctgtggtggtgatataataaagaccgtgagcggcctcgaggactccngagacgaatctcgtgcctcagctcgaggacaacagtcacgttcgaccatcgagtggactaccaagcaaggaagaccggaggctacggaacttagtaccacgttagtaacaaagttacgacaaacgtaacgaacgtaaccgtaaagtaacccgggtaaaccccgaaggttaacgggggtaccgtttaggggttacggggtttaccggggtttacccgggggaaccgggggtaaccgggggtaaaccccgtaaacgggtcccgttaaccggggtaaccccggtttaacccgttaaccgggtaccgaaaccccgggtacccccggtaaaacccggggg

SEQ ID NO: 102950 - DNA, 735 bp, Homo sapiens
  misc_feature: GYAE6OF01CXSOL.3.34.D01.1.454.CMB.1.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
tcagagacgcactccacgaccggtgctcgatttagatcgtctgtgttgggtttgggggtgggtcctaggaggcagaactctgggtgtctcaccaatggcctcggactcctctacttcctccccgtcctcactctctgcacgaggctctcgacggcctcctatgagctcgacacacgccacctcggtgtctagtcgtcccgaggacgacgacggccaggactcactcgctcgnggagatcgacagtgacaagtctatntagtcttacgacggtaccagtacaagaacgcgaccggccgacggtccccgtggttgggtggtacgtagtaagtaaagtaaacggacggtaggtaacggaccggtacccgttagaacgggtacctaccgacggaggtacctaacggtccgtcggttcggacccttccgaacggccgtaaaccggacgggaacctaacgtacgtacgtacgttacgaccttagcgtacgggcggtacgacgaggtacgaaggaacgtacggacgtcgtacgtaacttacgtaacctttagtacgtaaacgtaaacgcgtaaacgaacggtacgtaacgaacgttaaacggtacccggaacgttaacgggtacgttacggtaggggttccggttacggggaacgggtaccgggtaaacgggtccgtaaacggtacggtacccgggttaaccgttacggtaaccgaccggtaacccggtacccgtaaccggg

SEQ ID NO: 102951 - DNA, 723 bp, Homo sapiens
  misc_feature: GYAE6OF01D03D4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggactcacctgctcgtggagatgctagttggacaaagctatatgtcttactcggtaccagcaaggaacgccgaggccacggtcccctggtggtggtagatagtaaagtaaacggtaccgtggacggacggccgtacgagggtactacccgtaggacgaccgtaacttccgttacgtcgggtaccctacccgacggccgttacggaaacgggggaaccctaaacgtaccggttaaccgtaaccggtttaccggaaccctacggttacgtaacgggttacgggtacgttacccgaacggacgtaaagggaaccggtacgggaggtaccgtagaaccgttactaccgtacgttagtaaccaaagtacgacaacgaacgtagacgtaacgtaccggaccgtaaggtacggtcgttacgggttagggttaccgggttacggggacgggaaccgggtaccgaacgggtcccgttaacgggtaacccgttaccgtaacggtaccggtaccgtaccccgggtaaccgg

SEQ ID NO: 102952 - DNA, 752 bp, Homo sapiens
  misc_feature: GYAE6OF01BFJTN.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctagacacagccaccctcggtgtcagtcgtccccaggacaggacgccaggatcacctgctcgtggagatgctattggacaaagctatatgtccttacgtcggtaccagacgaacgaacgccgaacgcccgacggtcccccgtgggtgggttacggtagtaagttagtaaaacgtaaaacggtacccggtaggaacgaaccgggtccgtaacggtacgggtaacgtccccggtagaacggtacgtaaacttccgtacgttcgggcctacgacgcctacggaaacgggtaaccaacgtaacgtaccgtaacggttacgaaccgtacgtacgtaaggtcgggtaaccgtacggacggaacgaaaggaacgaacggtacgtacgtaaggaactactaccgtaacgtaacgtaacaaactagggaactacgaacgtaccgaaacaacggtaaccggaaaccaaggttacgggacgtttacgggtacgggtttacgggtacccggggtacgggaaaccggggaacctacgggttacccgtaaccgggtaaccccggtttaacggaacggtttacccgacgggtaaccccgtaaacccgggg

SEQ ID NO: 102953 - DNA, 525 bp, Homo sapiens
  misc_feature: GYAE6OF01A084O.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaaagctatatgcttactggtaccagcagaagccaggccaggcccctgtggtggtgatataataaagaccgtgagaggccctcagggatcccgtgacgcgaaatctacgtggctccagctcagggacaacgagtcacgttgaccatcagtgagtcagcagaagacggagctgactatcaatgtacaaatgacagacagacaacgtcggaaccctagtacggactggttaggtgttcgggacggacgggaccgaacgctacggtacccgtacgtaagtcgacggccgtaaccggg

SEQ ID NO: 102954 - DNA, 722 bp, Homo sapiens
  misc_feature: GYAE6OF01BB6D0.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatccacctgctctggagatgcattggacaaagtctatatgcttacgtggtaccagcagaagccgaggccacggcccctggtggtggtgataataagtaaagaccgtgagacggccctacgagggactcccgtgacgacgaacgtctacgtcggcctccgacggtcctacgaacgggtaacaaacgtacgtaccgtaacggttacgaacctaagtcgagggtcgggaacgtccgaaggaccgaaaggaaacgggaccggaacgggtaccgtacggtaacttacgtacctaacgttacgtaactaaaacgtacgaacgtaacgaaccgaacgtaacgaaacgtaaccggaaacccgtaagggttacgggtacgtttacggggttacgggtttacgggttaccggggaaccggggtaacgggtaacccggtaaacgggttacccgtaaccggggttaaccccggttaccggttaaaccgggtaccccgtaaaccggtacccccgggtaaaacccggg

SEQ ID NO: 102955 - DNA, 343 bp, Homo sapiens
  misc_feature: GYAE6OF01BKD2M.3.34.D01.1.454.CMB.1.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
  modified_base (342)..(343): a, c, t, g, unknown or other
  misc_feature (342)..(343): n is a, c, g, or t
tcagagacgcactccacgaccggtgctcgatttagatcgtctgtgttgggtttgggggtgggtccaggaggcagaactctgggtgtctcaccatggcctggatccctctacttcctcccctctcactctctgcacaggctctgagcctctatgagctagacacacgcccacccgtggtntcacgtcgtacccgaggacacggacgcagactcacctgctgtagganatgactgtaggaacaagcttatgtcgtacttacgtacgtaaccagacgaagacgccgacggccgaccggtccgtggtggtgataataagtaacgaaggacgtagacggacccggtnn

SEQ ID NO: 102956 - DNA, 744 bp, Homo sapiens
  misc_feature: GYAE6OF01A7TXF.3.34.D01.1.454.CMB.1.raw
tcagagacgcactccacgaccggtgctcgatttagatcgtctgtgttgggtttgggggtgggtccgaggaggcagaactctgggtgtctcaccatggcctggatccctctacttcctccccctcctcactctctgcacaggctctgaggcctcctatgagctgacacacgccaccctcggtgtcagtcgtccccaggacagaccggccaggatccacctgctcgtggagatgcagttggacaaagctatagtgtcttacgtaggtaccagcaagaacgcacggccacggtccccgtggtggtcggtagtaattaagtaagtaaaacggaccgtaggaacggacggacccgtacgaagggtactcccgtagacgtacgtaactcgtacgtcgggcctaccgacgtaccgtacggagggaaacctaacgacgtacgtacggttacgacctatacgtacggtaggaccggtaccgaggtaccgaaggaaccggtaacgggacgtacgtaacggtaccttaacggtacctacggtacgtaacgtaacgtaacggacctaacggaaccgtaacggaactaaacggtaacccgggtaaaccctaagggttaacggggtcggtttaagggttaccggggttacgggttacccgggaacgggggtaaccggtaaccgaaagggtacccgttaccggtaaaccccggtaccgttaaaccgggtacccgaaccgggtaccccgtaaacccgggg

SEQ ID NO: 102957 - DNA, 711 bp, Homo sapiens
  misc_feature: GYAE6OF01DZZ79.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctctcactctctgcacaggctctgacggcctcctagtgagctagacacacgcccaccgttcggtgtcaggtccgtaccccgaagggaccaggaccggccgaggactccaccgttggcctcgtaggagtacgtgctagttcggaactaaagtcttatagtcgtacttacgtacgtaccagacgaagacgccgacgccgacggtccgtggtggtggtagatagtaagtaacgacggtagacgacggtccgtacgacggacgttccgagaacggtacgtaacgtcgttacgtcgtaccgtaccgacgtccgtaacggacggaaaccgtaacgtacgttacgtacgttacgacctaacgtacgtaggtacggacgtacggaggacgaaggaacggagacgggacttacgactacgtctaacgttacgaactaaggtcaagaacgtacgaacgaactaacggtaaccgaacggtaacgttagggtaccggttagggttcgggttacgggtacggggacgggaaccgggtaaccggaacggttccggttaaccggtaaccggttaaccggaacgtacccggcggtaaccccggtaccgg

SEQ ID NO: 102958 - DNA, 855 bp, Homo sapiens
  misc_feature: GYAE6OF01CEX3F.3.34.D01.1.454.CMB.1.raw
  modified_base (136)..(136): a, c, t, g, unknown or other
  misc_feature (136)..(136): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcanaggctctgaggcctcctatgagctgacacagccacctcggtgtcagtcgtaccccgaggacagacggccaggactcaccttgctcgtaggacgagtcgactagttcggactaaaagctagttagtcgtaccttacgtacggtaaccacgacgaaggaacgacccgaacggcccgtaaccggcccccggttagggttacgggttggttaacgtaagtttaacgttaaacggttaaaacggtacccgggttaggaacggtaccggtaccccgttacggaacgggtaccttacccggtaggaccgtaacgtaacgttccgtaccgttacggtaccgtaccggtacgtaccgacggtaacgggtaacctaaacgacggttaccgtacggttaccaaccgttctaaccggtaggttacggacgttaccggaagacgtaaggaacgtaacggacgtacgtactaaaccgttacgtccctaagttaccgtaaaccgtaaagttaccggaacgttaaagggaaccctaaacggttaaccgaaccggttaaaccggaacccggttaaggttacggggttaccgtacggggggttacgttaccgggggtttaccgggaaccggggttaaccggggaacccggttaaaccggttcccggttaacccggttaacccggtaacccgggttaacgtaccccgggtaaaccggtacccgggttaaacccccggg

SEQ ID NO: 102959 - DNA, 698 bp, Homo sapiens
  misc_feature: GYAE6OF01CWOVS.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctctcactctctgcacaggctctgacggcctctatgagctgacacacgccctacccgtggtcgtcacggtccgtaccccgaggacacggaccggccaggtactccaccgtgctcgtagggatatcgactagttcggaactaaaggtcttaagttacgtcgttaccttaacgtacggtaccgagacgaaggacgaccgcggaccgtacggtcccgtgggtcggtaggtagtaatacgtaaagtaaacggacgtaggacggaccggtcctaggaacgggtcctccggacggacgtaccgtaacttccgtcggtacgaccctcgacgtcgacgaacggtaacaacggtcgtataccgtacgactacgacgtacggtagaccgtacgacggacgaaggaacggacggacgcgtaacgtactacgtacgtacgtaagaacgtaactacgacgtaacacgtacgaactacggtaaccgacgtacggtagggtcgttcgggtagggttaccgggtacgggaccgggacgtaaccggacgtaccgtacggtaccccgttagaccgtccgacggtacccggtaaccgg

SEQ ID NO: 102960 - DNA, 773 bp, Homo sapiens
  misc_feature: GYAE6OF01CDYSV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacacgacggccaggatcacctgctgtggagatgctattcggacaaagctatagtcgtcttacgtacggtaccagacgaaggaacgaccgacggccgaccggtccccgtggtgggtggtagtatataagtaaacgaccgtaggaggacgcccgtacgagggacctaccgtgacgtacgtaacgtcctcgtcggtcctaccgacgtcgtacggaacgggtaaccaagtaacgtaccgtacggtacgtacctacgtacgtagggtacggtacgtaccgaagggacgaaagggaaacggaccggaggtaccgtaagtaaccgtactaccgtaacgttacgaaacgtaaacgtaacgaacgtaacgaacgtaagaaccgtaacggtaaccgggtaacccgtaaaggttacggggtccgtttagggggtaaccgggtttaccgggggttaaccgggggaccggggaaacccgggggtaaaccccgtaaacgggtaccccgggtttaaacccgggtaaccccgggtttaacccgtaaaccgggtttacccgaaaacccgggtaacccccgggtaaacccccgggg

SEQ ID NO: 102961 - DNA, 829 bp, Homo sapiens
  misc_feature: GYAE6OF01CKE3A.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtggagatgcattggacaaagtctatagtgtacttacgtggtaaccagacaagaacgccgaggccacggccccgtggtcggtggtgaatataagtaaacgaccgtaggaggacggtccctgacgggactccgtagacgacgtaactctacgtcggtcctaccgacgtacgtacggaacgggaaccaaaccgtacggtaccgtaacggttacgaaccgtaacgttacggtacggttagggaaccgttacccggaagggtaaccgaaagggaaaacgggaaccgggaacgggtaccgttaacgtaacgttaacgttaccgtaacgttacggttaacgtaaaacgtttacggaaccgttaaacggaaccgaacggtaaaccgtaaaacgttaaccggggaaaaccccgttaagggttaacggggttaacccggtttagggggtttacggggtttacccgggggtttacccggggggaaaaccgggggtaaccgggggttaaaaccctaacccgggggttaaccgttaaccccggggttaaacccccggtttaaacccggttaaacccggggtaaacccggtaacccgggtaaacccccgggttaaacccccgggg

SEQ ID NO: 102962 - DNA, 759 bp, Homo sapiens
  misc_feature: GYAE6OF01BX7BX.3.34.D01.1.454.CMB.1.raw
tcagagacgcactccacgaccggtgctcgatttagatcgtctgtgttggggtttgggggtgggtccaggaggcagaactctgggtgtctcaccatggcctggatccctctacttctccccctcctcactctctgcacaggctctgacggcctcctatgagctgacacacgcccaccctcggtgtcagtcgtccccaggacagaccggccaggactccacctgctcgtagggatatgctattggacaaagcttatatcgacttacgtcggtaccagacaaggaacgccgaggacccgacggtccccgttggtcgggtaggtagtaatataaagtaaacggaccggtaggaaggaccgtacccgtacggaacgggtacctcccgtaggacgacgtaactccgttacgtcggtaccctaccgacggtccgtaccggaacgggaaaccaaacgtacggtaccgtaaccggtttaccgaaccctacgtacgtaacgggtacgggtaacccgttaccggaacggtaaccggaaagggtaaaccggaaccgggtaggtacccggttaagtaacccgttaaacgtacccgttaacgtttaggtaaacctaaagacggacgtaacggaccgaacgaaccgtaaacgtaccgggaaccctagggtacggttacgtcgggttagggttcggtaccgggaggggtaacgggacccgtaggccgttacggaacccgttacgaaccgtaccgtaccgggacccgtaacccggg

SEQ ID NO: 102963 - DNA, 706 bp, Homo sapiens
  misc_feature: GYAE6OF01BO4IH.3.34.D01.1.454.CMB.1.raw
  modified_base (293)..(293): a, c, t, g, unknown or other
  misc_feature (293)..(293): n is a, c, g, or t
  modified_base (534)..(534): a, c, t, g, unknown or other
  misc_feature (534)..(534): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccacccgtggtgtcacgtccgaccccgaggacacggaccggccaggactccacctgcttcgaggagatgactagttaggacaaagtactatatcgtacttacgtacggtacagacaaggaacncgacggccgacggcccgttggtcggtaggtagtaacgttaataaacgtaaacggacggtacggaacggaccggtacctacggaacggtaccttaccggaggaacgtaccgaacgttccgtacgttccggcctacgacgtacgacggaacggtaacaacgtagtacctacgtacacgtagacgtagtcgacgcgaaggacgaaggaacggacgacgtacgtacgtactactactaacgttanaacgtaactacgaaccaaggaaaccgtaccgaaacgttaacggaaacccggtacgtaacggtacggttcgggttaacgggtttcgggtaacgggttccggggaaacgggacggtaaaccgacgttacccggacgttaccggtaccgtaagacccgtcggtaaccccgtacgg

SEQ ID NO: 102964 - DNA, 788 bp, Homo sapiens
  misc_feature: GYAE6OF01D5TDV.3.34.D01.1.454.CMB.1.raw
  modified_base (236)..(236): a, c, t, g, unknown or other
  misc_feature (236)..(236): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctggaggcctcctatgagctgacacacgccctacccgtcggtgtcagtccgtccccgaggacaggaccggccgaggactccactgctcgtggagntcgctagttcggactaaggtcttaatagttcgtacttacgtcggtaaccagacgaaggtacgaccgtacgggcccgaccggtcccggttgggtcgggttaggtagttaaataacgttaaacggtaaaccggaccgggtagggaaccggaccgggtccccgttaaggacgggtacccttcccggagtacggtaaccgttaacgttccgttaccggtcgtaccccgttacgaccggaccgttaccggggaaacggtaacctaacggtttacccgtacgttaccgttaccgaaccgtattcgggaacggtcgggtaccgtacgacgggtactaagggacgacggagggtacctagtaacgttactccgtaacgttacgaaagaaccgtagacacggtaacctacgtacgaaaccgtaccggaaccgttagggtcggttcggtagggtagggttaccgggtaccggggaaggggtaccggttaaacgggacccgttcggtaacccccggttcggttaaccgaaccgtaccggggtaccccaaccggtaccccgggg

SEQ ID NO: 102965 - DNA, 701 bp, Homo sapiens
  misc_feature: GYAE6OF01B6AQ3.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgacggcctcctatgagctgacacacgcccaccgtcggtgtcagtcgtaccccgaggaccaggaccggccaaggactcacctgcttcgtggagatcgactagttggaacaaagtcttagtagtcgtacttacgtaggtaccagacgaaggaaccgccgacggccgaccggtccccgtggtcgggtaggtagtaacttaagtaacgtaaacggaccggtaggacggtaccggtcccgtacggacgggtaccttacccggaggtaacgacgtaacttcgtcgtcgcctacgacgtcgtacgacggaaccacgtacgtcgtacgtcgaactacgtacgtaggtacgtcgtacgaggacgaacggacgacgtcgtacgtaactactactactaacgtacgtaacaagtacgaacaagacgtaacgaacgtaacgaaccggtaactacggtacggtggttacgggttacgggtcgggtaacgggacgggaaccggtaccgtacggtcccggttaccggtaacccggttaacgtaccggacccgttaaccggcccggtaacccggg

SEQ ID NO: 102966 - DNA, 720 bp, Homo sapiens
  misc_feature: GYAE6OF01DA7MP.3.34.D01.1.454.CMB.1.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
tcagagacgcactccacgaccggtgctcgatttagatcgtctgtgttgggtttgggggtgggtccaggaggcagaactctgggtgtctcaccatggcctggatccctctacttctccccctctcactctctgcacaggctctgaggcctctatgagctgacacagccaccctcggtgtcagtcgtccccaggacagacggccaggatcgacctgctctggagatgcattggacaaagctaatangcttactggtaccagcaagaanaccgagccacggcccctggtggtcggtagatagtaagtaaacgaccgtgaagacggccctagaacgggactccccgtagagacgtaatcctcgtacggccttaccaagtctagtacggggaccaaacgacgttacacggtttacgaaccgtactcgtaggtggacgtacgaacggcaacggaaaaggccggagtccgtaggaacctagtaccgtactacggtaactaaaacgtcggacgtaaacgaccgtaacggtaacctaaacggttaaaccgggaacccctaaagggttacggggtaccttagggggtttacgggtttaccggggtttaccgggaaacccggggggtaacgggtaaaccccgtaaaacgggttccggttaaccgggtaaccccccgttttaaacgttaaccgggtttaacccgaccgggtaacccccgggtaaacccgggg

SEQ ID NO: 102967 - DNA, 744 bp, Homo sapiens
  misc_feature: GYAE6OF01DZXNI.3.34.D01.1.454.CMB.1.raw
  modified_base (138)..(138): a, c, t, g, unknown or other
  misc_feature (138)..(138): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacnggctctgacggcctctatgagctgacacacgcccacccgtcggtcgtcacgtcggtccccgaagggaccacggaccggccaggtactccgtaccgtgccttcgtagggagtatggactagttcggaacaaagtctattagtcgtacttacgtggtaccagacgaagaacgccgacggcccacggccccttggtggtggtagattaagtaagtaaacggaccggtaggacggacggtcccgtaggaacgggtacttccgaggacgacgtaacttcgtcgtcggccttaccgagtccgtacggaacggaaccaacggtacgttaccgtaacggttcgaacccgttagtaccggtagggttaccgggtaaccgtcccggaaagggtaaccaagggaaccggaacggacggtacgtacgtaaacctacgttacctaacgttacgtaaactaaacgtacgtaacgaacggaaccaacggaaccgtaacgtaaccggaacccgtaaggtcgggtagttcggttaggggttacggtaccggggtacggaaaccgggtacgaccggtacgaccgtaaccggtaccgttaacggccgaccgtccccggaaccggg

SEQ ID NO: 102968 - DNA, 709 bp, Homo sapiens
  misc_feature: GYAE6OF01DJEUS.3.34.D01.1.454.CMB.1.raw
  modified_base (184)..(184): a, c, t, g, unknown or other
  misc_feature (184)..(184): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgacggcctctatgagcctagacacacgtcccacccgtggtntcacgtcgtacccgaggacacggaccggcaggactaccactgctgtaggagatgactagttaggacaaagcttaagtatacgtacgttacgtacggtacaacgagaagaacgacgacggaccgacggtcccgtggtggtacggtaagtaatagtaaactaaaacggaccgagtaacggaccgtaccgtacgaggtaccgtacgtacgacgtaacgtaacgttctacgtacggcctaaccgacgcgttaacggaacgggaaactaaacggtacggtactacggttacgaccaagttcggagtacggacgtacgaacggtaacgaaacgtaggaacggaagtcgtaacgtaacagtacctaacgttaacgtaacaaacggtgaacgacgacgaacgtaaacgaacgtaaccggtaaccgaagttacgggtcggtaaggttcgggtagggtaacggacggggtaaacggaccgaacggtgtaacccggtaactaacggaccggttaaccggacgtacccgtaaaccgg

SEQ ID NO: 102969 - DNA, 733 bp, Homo sapiens
  misc_feature: GYAE6OF01CPHUC.3.34.D01.1.454.CMB.1.raw
  modified_base (158)..(158): a, c, t, g, unknown or other
  misc_feature (158)..(158): n is a, c, g, or t
  modified_base (161)..(161): a, c, t, g, unknown or other
  misc_feature (161)..(161): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagagacgcactccacgaccggtgctcgatttagatcgtctgtgttgggtttgggggtgggtccaggaggcagaactctgggtgtctcaccatggcctggatccctctacttcctccccctctcacttctctgcacgaggctcgtgacgtcctctanganctagacacacgccctacccgtggtgtctaggtcccgacccgaggaccagggaccgtccaaggtctccaccgtgtccctagtaggaagtnttacgcgtagttaggaacaaagtcttaatagtcgtacttacgtacgacagacgaagaacgccgacggtaccgaccggtccgtggtaggtggtataatagtaaacgtaaacgcggtagacggaccgtccgtacggaaggtacccncccgtaaggacgtaccgtactacgtcgacggtcctaacgcgtacgaacggacgaactaacgtaggtaccttaaggtaccacgtacgtacggtacggtacgaccgtacgaacggaacgtaaggaacgacggtagacgttaccgaatctaaccgtagtaacgtaacgtaagcgaaacgacgaacgttaagaccggtaaacaaccgggtaactgggtacgtcggtttgggaacgggttcgggtaaacccggtaggggaaaccggtaacgtacccgggttaacgttaacccggtacccgtttaaacgacccgggtaaacctccccggggtaccgtaccccggg

SEQ ID NO: 102970 - DNA, 656 bp, Homo sapiens
  misc_feature: GYAE6OF01A8BD5.3.34.D01.1.454.CMB.1.raw
  modified_base (460)..(460): a, c, t, g, unknown or other
  misc_feature (460)..(460): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctggtgtcagtcgtcccaggacagacggccaggactcacctgctcgtggagatgcagttggacaaagtctatagtcgcttactggtaccagacagaagccgaggccacggccccgtgtggtggtagataagtaagaaaggaccgtaggagacggccctagacgggactccgtgagacgtaactcgcgtggcctcgagcctgaacgggacctaacgacgtactacgttacgacctatcgaacgtcggacgtcccgaggacgaaggaacgacggacgtacgtagaacctanaccgtacgtagtaaacgtaagtacgaacgaacgacgaacgtaacgtaaagtaacccggaaccgtaaggttacgggtaccgttgggttacgggttaccgggttaccggggacggggtaacgggtaaacccgtaacggtacgtaacccggtaacccggttaaccgttaaggacccgtaaacccggtcccgggaaccgg

SEQ ID NO: 102971 - DNA, 690 bp, Homo sapiens
  misc_feature: GYAE6OF01BCF8K.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccagggacaggaccggccgaggactccacctgcctcgtggagtatgctagttcggaacaaagtctatatcgtacttacgtacggtaaccacgacgaaggaacgaccgacggtaccgaccggtccccgtggttcgggttaggtagtaattaagtaaagtaaaaccggtccggtaggaacggtaccggtccctaggaacggtacctccgtaggacgacgtactcgtcgtcggtcctcgacgtccgtacggaacgggaacctaaacgtacgtaccgtacggttaccaacgtacgtacgaggtacggacgtacgaaggacgaaggaacgacggacgtctacgtactacgtacgtacgttagaactaagcgaacacgactacgaacaacgtaaccgactaggttaacggtggttggttacgggtacggtacggggacgggtaacggtaccgtacggtacgttaccggtaccgtaacgtaacggacccgaccggtcccgtaaccggg

SEQ ID NO: 102972 - DNA, 684 bp, Homo sapiens
  misc_feature: GYAE6OF01CR3YB.3.34.D01.1.454.CMB.1.raw
tcagagacgcactccacgaccggtgctcgatttagatcgtctgtgttgggtttggggtggtccaggaggcagaactctgggtgtctcaccatggcctggatccctctacttcctcccctctcactctctgacacaggctctgacgtcctctatgagctagacacgacgccctacccgtggtgtcagtccgtaccccgaggacgacggacgaccgagactccactgctgtggagatgactagtacggacaaagtctagtacgtgtacttacgtacgtaccagacaagacgccgacggcctaccggccgttggtggtagtagtattaacgtaagtaaaccgacggtaggaacggaccgtacccgtaggaacgggtacctccggaagcggaaccgtaattccgtacggtacggccctacgagtccgtaagaacgggaaactaccgtagtaccgtaaccgtacggaaccacgtagtacggtaggacgtacggacgaacgaagaacgtacggagtacgtacgtactagacctacgattaaccgaagtacgaacgaacgaacgaaccgtaacgaacgttaccggaaccgttaagggtcggtacgttggtacgggttacgggaccggacggggtacgaaccgtacgacggtacgttaaccggtactaacggtaccacggtacccgtaccgg

SEQ ID NO: 102973 - DNA, 710 bp, Homo sapiens
  misc_feature: GYAE6OF01A6K2A.3.34.D01.1.454.CMB.1.raw
  modified_base (140)..(140): a, c, t, g, unknown or other
  misc_feature (140)..(140): n is a, c, g, or t
tcagagacgcactccacgaccggtgctcgatttagatcgtctgtgttgggtttgggggtgggtccaggaggcagaactctgggtgtcctcaccagtggcctggactccctctacttcctcccctctcactctctgcacgnggctcgtgacgcctctagtgacgctacgacacacgccctacccgttggtcgtcaggttccgtacccgaaggaccacggtaccggccgaaggtacttacccaccgtggtccttacgtaggggaatagttcggacctaggttacgggaaccaaaaggtcttaagtacgtcggtacctttaacgtacggtaaccgacgagaacgaacgccgacggaccgaccggtcccgtggtgggtacggtacgattaagtaaacgtaaacggtccggtagacggccgtcccgtacggagggtacctccggtagacgtaacgtaacgttccgtcggcgtacctcgacgtccgtacggaacggaacaacgtcgtacgtacggtacactagcgtaaggtcgacgtaccgagtacgaaggtacgacggacgtacgtactaactacgtacctaagtacttaacgaaagttcgaccaagactagacgtaacgaccggtaaccgtggtacggcgttggtacgggtcggtccgggaacggacgtaccgagtaccgtacgtaccgttacgacgtacgccggtaccgacgg

SEQ ID NO: 102974 - DNA, 699 bp, Homo sapiens
  misc_feature: GYAE6OF01EZ3VT.3.34.D01.1.454.CMB.1.raw
  modified_base (243)..(243): a, c, t, g, unknown or other
  misc_feature (243)..(243): n is a, c, g, or t
  modified_base (636)..(636): a, c, t, g, unknown or other
  misc_feature (636)..(636): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgacgcctcctatgagctgacacgagccctacccgtcggtagtcgagtcgtcccccgaaggacacggaccggccaggtactccgacctgccgttcgtgganatgactagttggaacaagtctatacgtcgtcttacgtacgtaccagacgaagaacgaccgtacggaccgaccggtccccgtggtgggtggtagaacgttaagtaaacgtaacgtaccggtaggacggaccggtcccgtacgacgggtacctcccggtagacggtactaacgtcgtccgtcggcctcgacgtcgtacggaaggaccaacgtcgtaccgtacgttccgaacttagtaccgaggttcggtacgtccgaaggacgtaaaggaacggaacggacgtccggtaacgtacgttaaccgtacgtaaacgtttaacgttaaagacgtagaagacgacgtaaccaaaggtaccgaaccgtggaacggtcgtaggttgggtacggtaccggggnggtaacggacgacggtaccgtacgtaaccggttcgaaactcggacccgaaccgcggttccccg

SEQ ID NO: 102975 - DNA, 749 bp, Homo sapiens
  misc_feature: GYAE6OF01B30CB.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcagttggacaaagctatatgtcttacgtaggtaccagcaagaacgccgaggccacggccccctggtggtggtgagtataataaacggaccgtaggacggacggccctacgacggggtactcccgtaggacgacgtaactcgtcgtggcctccgacgtccgtaccgtaagggaaccaaacgtcggtaccgtaaccgttacgaccctaactacgtacggtacgggaacggttaccgaacgggacgaacggtaaacggaccgggaacggtaccgtacggtaacctacgtaccgacgttaacgtaaacctaaagtaacgtacgaacgaacgtaacgaaccgtaaacgtaccgggaaaccctagggttaaccgggacgttcggggttacggggtttacgggttaccgggggtaacggggtaaccggggtaaacccggtaacgggtacccggttaaccgggtaacccccggttaaccggttaaacccgggtacccggaaaccccggggtaccccgttaaaaccccggg

SEQ ID NO: 102976 - DNA, 322 bp, Homo sapiens
  misc_feature: GYAE6OF01C154E.3.34.D01.1.454.CMB.1.raw
  modified_base (309)..(322): a, c, t, g, unknown or other
  misc_feature (309)..(322): n is a, c, g, or t
tcagagacgcactccacgaccggtgctcgatttagatcgtctgtgttgggtttggggtgaggtctgtgtcactgtggtattactatggttcgggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggcaaggactacttccgagtgcgtctctggacgcgggctggcaaggcgcatagnnnnnnnnnnnnnn

SEQ ID NO: 102977 - DNA, 785 bp, Homo sapiens
  misc_feature: GYAE6OF01DHWXE.3.34.D01.1.454.CMB.1.raw
tcagagacgcactccacgaccggtgctcgatttagatcgtctgtgttggggtttgggggtgggtccaggaggcagaactctgggtgtctcaccatggcctggactccctctacttcctccccctcctcactctctgcacaggctctgacggtcctcctatgagctagaccacacgccctacccgtggtgtcgtacgtccgtaccccgagggaccgacggaccggaccgaaggtactaccaccgttgaccttcgtaggaagtagtgacgtaggtacggaacaaaggtctaatagttacgtaccttaacgtacggtaaccacgacgaaggacgaccgacggaccgaccggtccccgttgggtcgggttaggtagtaacttaagtaaacgaaacggtaccggtaggaacggtaccggaccgtaacggacgggtacctaccgtagacgtacgtaactcgtcgcgtcctacgacgcgtacggaacggaacctaacgtaccgtacgtaaccggttacaaccgtacgtaacggtacgggtacggtacggaccgaaggaaccgaaagggaacgtacgggacggtacgtaacgtacgtaacctacgtaacgttaggtaaccaaaggttaccaacgacggaacctaacgtaaccggtaaaggtaacccggtaacgtaacgggtcggtaacggttcgggttggggtacgggttaccggggacggggtaaacgtacggaacgggtcctaacccgggtaaccacggttaccgaccggtaaccgtacccggtaacccgg

SEQ ID NO: 102978 - DNA, 790 bp, Homo sapiens
  misc_feature: GYAE6OF01EAE5D.3.34.D01.1.454.CMB.1.raw
  modified_base (157)..(157): a, c, t, g, unknown or other
  misc_feature (157)..(157): n is a, c, g, or t
  modified_base (176)..(176): a, c, t, g, unknown or other
  misc_feature (176)..(176): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgagcctctatganctgacacagccacctggtntcagtcgtcccagacagacgcaggatcactgctcgngganatgctagttggacaaagtctaatgtcgtacttacgtacggtaccagacaagaacgaccgacggaccgacggtccccgtaggttcgggttaggtaggtaattaaagttaaacgtaaaacggtaccggttacggaacgggtaccggttaccccgtaacggtaaacggggtaacccttaccccgggtaggtaccggaaccgttaaacgttcccgttacgtacggccttaacccgacgtaccgtaccggaacggaacctaacgacgtaccgtacgtacgaactatacgtacggtaggacgtaccgaaggacgaaggaacgacggtagtcgtaacgtaaccgtactacgtacgttaacgtaagtaaacgtacgaacgtaaacgaaccgaacgtaaccggtaaacgtaacccggaaccgttaaagggttaaccggtaggttcggggtttaacggggttacggggttaccgggggaaccgggaacccggggtaaaccgtaacgggttacccgtaaaccccgggtacccgttaaaccggttaaacccgttacccgggaaacccggtacccggtaaacccggg

SEQ ID NO: 102979 - DNA, 630 bp, Homo sapiens
  misc_feature: GYAE6OF01A2SSS.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctatatgacttacgtagtaccagcagaacgccgacggccacggccccttggtggtggtagtatagtaataaacggtaccgtaggacggacggtccctacgaggggtacctcccgtaggacggacgtaactcctcgtggcctccgacgcgtaccgaagggaacaacgacgtcctacgttacgacctatcgaggtcggagtaccgaggacgaaggaacgacggaggtactacgtactatcgacgtacgtaacaacgtacgaacacgaacgacgaacctaaagtaccgggaaaccaggtacgggtgttacggtaggggttcggtcgggacggggacgggtaccaacggtcgtaccggtaccgtaaccgttagacccgtacgtcccgtaaccggg

SEQ ID NO: 102980 - DNA, 772 bp, Homo sapiens
  misc_feature: GYAE6OF01CDWQR.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgacggcctcctatgagctacgacacacgcccacccgttggtgtcagttcgtaccccaaggactacgaccggccaaggtactccaccgtgtccgtcgtaggacgtagttgacctagttcggaaacaaacgtacttagtactcgtactttacgtacggtaaccgagacgaagaaacgccgaccggtaccgaccggtccccgttgggtcgggttaggtagtaaagttaacgtaaacgtaaaacggtaccggtaggaacggaccggtacccgtacggtaacgggtacctccggtaacggaacgtaccgtaacgttccgtcgtaccggtaccgtaccgtacgtccgtaacggaacggaccgaaacgtacggtactacggtacgaacctagtcggtaacggtggaccgtaacgacggaacgaagggaaacgacggtacgtacgtacgtaagtaaccttgtaacgtaacgttaaacgaagtaccgaacaaacgacgtaacgaacgtaacggttaacccgacgtaacggtacggttcgtacgggttacgggttacgggtaccgggacgggtaaaccggcgtaaccggtccgtaaccggtccgtaaacgtacgtaaccgaccggtaccgtaacccgg

SEQ ID NO: 102981 - DNA, 755 bp, Homo sapiens
  misc_feature: GYAE6OF01C4ZKG.3.34.D01.1.454.CMB.1.raw
  modified_base (183)..(183): a, c, t, g, unknown or other
  misc_feature (183)..(183): n is a, c, g, or t
  modified_base (577)..(577): a, c, t, g, unknown or other
  misc_feature (577)..(577): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctccactctctgcacaggctctgagccctcctatgagctgacacacgcccacccgtggtntcagtcgtcccaggacgacgacggccgaggactcacctgctcgtggaacagtcgctagttggaaccaaagtctaattacacgttaccgttacgtgtaaccgaagtaccgaagtaacgaccgtacggcccgtaccggtccccgttaggttgggtcgttagaagttaacgtaaagtaaaccggtaccgtaggacgggtaccggcccgtacggtaacggaccttccgtaagacgactacgttccgtaccggtcggtacccttaccgacggtcgtaaccggaacggaaccaaacgtcgtaccgtacgtaccgaaccgtacgtcgtaggtaccggtacgtcgaacggtagaacgaggacgtcgaacgtctaatcctacgtacgtacgaaacttaaacgngtaaccgtaacgaacgtacggaaactaacggtaaccggtaaccgacgggttacggtcggttacgggtcggggtttaacggacccgggggtaacggaaacccgggttaaccggaaccggttaccggtaccgtaaccccgggttaacctaaggtccccgaaccgggtcccgaaccccggg

SEQ ID NO: 102982 - DNA, 710 bp, Homo sapiens
  misc_feature: GYAE6OF01D98IQ.3.34.D01.1.454.CMB.1.raw
  modified_base (530)..(530): a, c, t, g, unknown or other
  misc_feature (530)..(530): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctggtgtcagtcgtccccaggacagaccggcaggactccacctgctcgtaggagatgctagttggaccaaagtctatacgtgtacttacgtcggtaccagcgaagaacgccgacggccacggtcccctggtgggtcggtagataataagtaaacggaccggtagacggacggtccccgtaggacgggtaccttacccgagtacggacgtaacgtccgtacgtcggcctaccgacggtcctacggaacggaaccaacgtacgtaccgtaacgtacgtaccgattacgacggtacggtacgtaccgaaggacgaaaggaacgacggacgtacgtagaacgtacgtactacgtacgtaanaacgtagacgtaacgacgtacgaactaacggtaacccggaacgtaggtacggtcggtttacgggttacgggttaccggggtacggggaaccggggtaacgggaaacccggtacggttaccggtacccggtaacccggttaaccggttaaccggaccggaacccggtaccggtaacccggg

SEQ ID NO: 102983 - DNA, 810 bp, Homo sapiens
  misc_feature: GYAE6OF01E1O9E.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctggagcctcctatgagctgacacacgcctacccgtcggtgtcagttcgtcccccgaaggacacggaccggccaggactaccgaccttcgccgttacgtaggaagtagtcgtactagttaggacaaagtctatagtcgtacttacgtaggtaccagacagtacgacgacggaccgaccggtcccctaggttcgggtaggtgtaacttaagtaacgtaaaacgggtacccggtaggtaacggtaccggtccccgtacggacgggtactacccgtagaccgtcggtaactccgttcgtcggccgtaccacgtaccgtacggaacgggtaccaaccgtagtaccgtacggtaccgaaccgtactacggtacggtacgggacgtaccggacggaacgaacggacggaccggacggtacttacgaaccgtctaccgttacgtaacgtaacctaaagtaccaacggtaacggaaccgtaacgaacgtaaccggttaaccggaaacccgtaagggttaccgggtagggtttacgggtttaccggggttcgggggtaccggggtaaccgggggttaaccgggaaaccgggaaaccggttacccgggtaacccggttaaccccggttaaccgggttaaacccggtaccggaaacccggtaaccccgggtaaccccggg

SEQ ID NO: 102984 - DNA, 859 bp, Homo sapiens
  misc_feature: GYAE6OF01BOKEP.3.34.D01.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggntcacctgctctggganatgctagttggacaaagcttatatcgtcttacgtacggtaccagacaggaacgccgaacggcccgaacgggcccccgttggtcggggttaggttcggtaattaagttaaacgtaaaacggtacccggttaggacggtaccgggtaccccgttacgaaacggggtaccttaccccgtaggtaacggaaccgtaaacgttccgttacgtccgggtaccctacccgtacgtcccgttaacgggaaacggggaaaccctaaacggtaacggttacccgttaaccgggtttacccgaaacccgttaacttaccgggtaacggttacggggtaaccggttaacccggaagggaccggaaagggaaaccgggtaacccgggacgggtaccgtttaacggtaacctttaacgtaccgtaaccttacggtaaacctaaacgtaggtaaccgaacgtaacgaaccgaacgtaaaccggtaaccgaaacccggtaaggttaccgggttagggttacggtttacgggggtcgggtttcccgggggaacggggtaaaccgggtaacccggtaacggtcccggttaaccggtaacccccggttacgtaaaccgggtccccgtaaccgggaaccccggttaaccccggg

SEQ ID NO: 102985 - DNA, 680 bp, Homo sapiens
  misc_feature: GYAE6OF01A284Y.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattggacaaagctatatgcttacgtgtaccagcagacgccgacggccacggcccctgtggtggtgatataataaagccggtagagacggccctgaggactccgtaggagacgtaatctacgtcggtcctaccgacgtctacggaacgggactaacgtacgttaccgtacggttacgacctacgtacgtaaggttgggacgtacccggaggtaccgaagggaaacggacggagggtactacggaaccttaacgtaccgtaacgttacgtaactaaagttacggaacgtacgaacgacgtaactaagtaccggaacccgtagggtaacggtcggttcgggttcgggttacgggttaccggggtaccggggaacgggtaacccggaacggttccggttacccggtaacccggttacccggtaaacgtccggaaacccggtacccgtaacccgggg

SEQ ID NO: 102986 - DNA, 731 bp, Homo sapiens
  misc_feature: GYAE6OF01EHRLR.3.34.D01.1.454.CMB.1.raw
tcagagacgcactccacgaccggtgctcgatttagatcgtctgtgttggggttgggggtgggtccaggaggcagaactctgggtgtctcaccatggcctggactcctctacttcctcccctcctcactctctgcacaggctctggacggcctctatgagctgacacacgccctacccgtcggtgtcacgttcgtccccgaggaccacggaccggccaggactccacctgcctcgtaggagtatgctagttcggacaaagtactatagtcgtactttacggtacgtaaccgagacgaacggacgccgaacggcccgtaccggtccccgtagggttcggtaggtacgtaacttaacgtaaaggtaaaccggtaccggtaggtacggaccggtccctaggaacggtcctcccggtaggaccgacgtaactcgtacgtcggcctacgcgtaccgtacggacggaaccacgtacgtacgtaccgttacgaccgtacgtacgaggttacgacgtacggaacggacgtaacgggaaacggtacgacggtccgtaacgtacgttacgtaccgtaacgttacgtaactaaacgtccgaaccgaagtaacgtaacgtaaccgtaaggtaacccgggaaccgtagggtacgggtcgttggggtacgttacgggtacgggacggaacggtaccgtaacggtctaccggtaccgtactaacggtccgacccgaccggtacccgg

SEQ ID NO: 102987 - DNA, 751 bp, Homo sapiens
  misc_feature: GYAE6OF01AJCP9.3.34.D01.1.454.CMB.1.raw
  modified_base (136)..(136): a, c, t, g, unknown or other
  misc_feature (136)..(136): n is a, c, g, or t
  modified_base (233)..(233): a, c, t, g, unknown or other
  misc_feature (233)..(233): n is a, c, g, or t
  modified_base (638)..(638): a, c, t, g, unknown or other
  misc_feature (638)..(638): n is a, c, g, or t
tcagagacgcactccacgaccggtgctcgatttagatcgtctgtgttgggtttgggggtgggtccaggaggcagaactctgggtgtctcaccatggcctggatccctctacttcctccccctctcactctctgcanggctctgaggcctctatgagctgaccacacgtccccacccgttggtgtcagtccgtacccgaggaccaggaccggccaggtactccacctgctacgnggagtatgctagtcgacaagcttaatctcgtcgttacgacggtaaccagacaaggaccggccgacggcccgtacggtccccttggtgggtacgtataagtagtaaacgtaacggcgtaggtaccggaccgtacccgtaggaccggtacctccggtagaaccgtaccggtaactccggttacgacgttccctacgacgtcgtaccggaacggtaacaacgtaacggcttaacggtcgtaacgtgtacggtacgggtcggtaacctacggaaggtaaccgaacggtaaacgggtccggtacgtccggttaacgaacgtttacaccggtttaggtaacctaacggtaacgtcgaaccgtaagggaacccttacgaagtttaaacccgggaacggtaccggttaacggnggttcgtaacgggttgggtacccggggtaggtaacggggacccggtaacgtacccgggttgttaaccccgtaccgttaacggttacccgaagaccccgggttccggtaccccg

SEQ ID NO: 102988 - DNA, 655 bp, Homo sapiens
  misc_feature: GYAE6OF01C8ONF.3.34.D01.1.454.CMB.1.raw
  modified_base (158)..(158): a, c, t, g, unknown or other
  misc_feature (158)..(158): n is a, c, g, or t
  modified_base (257)..(257): a, c, t, g, unknown or other
  misc_feature (257)..(257): n is a, c, g, or t
tcagagacgcactccacgaccggtgctcgatttagatcgtctgtgttggggtttgggggtgggtccaggaggcagaactctgggtgtctcaccatggcctggatccctctacttctcccctcctcactctctgcacagctctgaggccctctatgagntcccgacaacagcccacccgtcggtgtccagtcgtaccccaggaccagacggccaggatccacctgctcgtggacgatgctattggacaaagtctaatntgcttacgtggtaccagacacgaaagccacggacccgacggtccccgtaggttcggtaggtgaattaacgttaagtaaacggacccgtaggacggtacggccccgtaggaacgggtactcccgtaggacgtacgtaacgtctcgtcgtccgaccgtagcgtacgtaaggaccaacgtacgtcgtacgttacgacagtaccgtagtaggacgtccgtaagcgtaaagacgacggacgtactacgtaactacgtacaacgtgtaaccaaagtacgacaacggacacgactaacgtacgaacctagggtacgtcggtaggtcgggttacggtccggggaaggtaacgggaccctaaggtcgtaaccggtccgtacgttaacgtccacggccggtaaacccg

SEQ ID NO: 102989 - DNA, 708 bp, Homo sapiens
  misc_feature: GYAE6OF01CV9IO.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggactcacctgctcgtggagatgcattggacaaagctatagtgtactttacgtcggtaaccagaccgaagaacgccgaggacccacggcccctgggtggtggtagtaactagtaacgtaaaacggaccggttagaaggaccggtccccttacggaacgggtaccttccccgtaggaacgtaccgttaagttcccgtacgtcggccctaccgacgtccgtacggaacgggaacctaacgtacgtaccgttaacggttaccgacctacgtacgtaggtacggacgtacggaagacgaaaggaacgacggtagcgtaagtacctactacgtacgtactaacgaagtagacgtaacgacgacgaaccgtaaggacccggtaacgtagggtacccgttaggtcgggttacgggtaccggtacggggaacggaaccggtaacgtaaccgggttccgtaccggtaacccggttaacgtaagtacccgaacccggtaccggtaaccccgg

SEQ ID NO: 102990 - DNA, 697 bp, Homo sapiens
  misc_feature: GYAE6OF01DEY9M.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctcgtggagatgcattggacaaagctatatgtacttacgtacggtaccagacgaagaacgaccgacggccacggtcccctggttcgggtggtagtactaagtaagtaaacggtccgtgtaacggacggtaccccgtagacgggtactccccgtagacgaccgtaattccgtacgttcggacctccgacgacgtacgaacgggacaacgtagtacgtacgttcgacctacgtacgtaggtacggtacgtacccgaagggacaacggtaaaggaaccggtacggtagtacgtaacgtactaccgtaacgtacgttaacgaaagttacgaaccgaacgtaaccgagaaccgaattaacccgggaaccctaaggttaccgggtcgtcgggttagggtttacgggtacgggtacggggtaccgggtaacgaacggtaccgtacggtaaccccgttaacgacggtaccgaccggtacccgtaacccggg

SEQ ID NO: 102991 - DNA, 601 bp, Homo sapiens
  misc_feature: GYAE6OF01BZEG1.3.34.D01.1.454.CMB.1.raw
  modified_base (442)..(442): a, c, t, g, unknown or other
  misc_feature (442)..(442): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgacggcctcctatgagctgacacagccaccctcggtgtcagtcgtccccaggacaggacggccaggatcacctgctcgtggagatgcagttggacaaagctatatgtcttactggtaccagcaagaacgccaggccacggcccctggtcggtggtgatataagtaaagccgtgagacggtccctgaggtactcccgtagacgtacgaatcctcgtggcctcaacgtctacggagggacaacgcgtcaacggttgaacctatcgaggtcggactccgaaggtcaaggaacgtaggacggtntacgactactcaacgtagtacaaagtgaaccagaaccaggaactaagaccgggaacccaggtaacgggcgttagggttcgggtcggttaccggggcgggaaacgggaccgaagtcccggtacgtaaccggttactaaggccgaacgcccgtaaaccggg

SEQ ID NO: 102992 - DNA, 552 bp, Homo sapiens
  misc_feature: GYAE6OF01E5AZD.3.34.D01.1.454.CMB.1.raw
  modified_base (440)..(440): a, c, t, g, unknown or other
  misc_feature (440)..(440): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgctactggtaccagcagaagccaggccacggccccctgtggtggtgatatataaacgacgtgaggacggccctcgagggactccgtgagcaatctctggctccagctcgagggacaacagtcacgttgaccatacgagtggacgtccgaggcaagagacggagcgtagactatcactgtacctaaagcacgagaacganaacaacgtacgaaccagtagggcttgggtacggttggttcgggaggggaccgggaccgtaagcccggttacggacccgttacccggaacgtccgacggaccccgtaaccggg

SEQ ID NO: 102993 - DNA, 840 bp, Homo sapiens
  misc_feature: GYAE6OF01D8PRA.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctggaggcctcctatgagctgacacacgcccacccgttggtgtcaggtcgtaccccgaggaccacggaccggccgaggactaccaccttcgccgtcgtagggagtatcgctaagttacggaacctaaagtcgttaattacgttcggttaccttttaaccggtacggtaaccgaggaccgaaaggaacggtacccgaaccgggaccccgaacccgggtccccggttagggggttcgggttagggttaggtaaatttaaagttaaaacggttaaaacggtacccgggttagggaaccgggacccggtaccccgtaagggaaccgggtacccttaccggtagggaacggtaccgtaacttccgttcgaccgtccgtaccggagtaccgtacggaacgggaacctaacgtaacggtccgtacgttacgaccgtagtacgtaggtacggaccgtccgaaggtaacgaacggaacggacggacgtacgtacgtacgttactaccgttagttaccgtaacgaaacgtcgaaacgtacgaaacgtaccggtaacgtaaaccggtaacccgaaaccgggttagggtaaccgggttcggtagggtttacgggtacgggggttaccgggaaggggaacccgggaacgtaccgggtacggtacccggttaacccggtacgaccgacccggtaacccggcggtaacccggg

SEQ ID NO: 102994 - DNA, 629 bp, Homo sapiens
  misc_feature: GYAE6OF01ETCH8.3.34.D01.1.454.CMB.1.raw
  modified_base (180)..(180): a, c, t, g, unknown or other
  misc_feature (180)..(180): n is a, c, g, or t
  modified_base (495)..(495): a, c, t, g, unknown or other
  misc_feature (495)..(495): n is a, c, g, or t
  modified_base (597)..(597): a, c, t, g, unknown or other
  misc_feature (597)..(597): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccacccgtggtntcagtcgtcccaggacagacgcaggatccactgcttctggagatgctagttggaacaaagtctagtacgttcgtacttacgtacggtaaccagacgaacggaacgccgacggacccgaccggtccccgtggttgggtggtgaatataagtaaacgaccggtagacggtaccgtcccgtaggacgggtactaccggtaggacgacgtacttccgtcgtcgggacctcgacgtaccgtacgacggaacaacgtacggtcgtaacgttacgactatacgaggtgacgtaccgagacgaacgtaaggacgagtaccganaacgttacacctacgtagtaactaacgcgacaagacgtacgaactagaccgaaccgtggacggtcgttaggtggtcgggtacggacgggaacggacgacggnttaccgtaccgtactaagcgaccgcgtacccg

SEQ ID NO: 102995 - DNA, 765 bp, Homo sapiens
  misc_feature: GYAE6OF01ENUJW.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgacggcctctatgagctgacacagcccacccgtggtgtcagtcgtacccaggacaggacggcaggactccaccgtgctcgtaggagtacgtgactagttcggacaaaggtcttaagtagttgtacttacgtacggtaaccagacaacggaacgccgacggaccgacggtcccgtggttacgggtggtagaattaagtaaacggtaaacggaccggtaggacggtacggcccgtagacgggtacctccgagacgtacgtaacgtcgtacgtcggcctacgtacgaccgtacggaacgggaaacctaacgtacgtaccgtaaccgttacgaacgtacgtacgtacggtacgggacgtacggaacggacgaaaggaacggacggtacgtaccgtaaggtactacgtaccgtacgttacggtaacaaagtaaccgacgtaacgaacgtaagaaaccgtaaggtacccggtaaaccggtaggttaccgggtaagtttacggggtacggggttcgggttaaccggggaaacggggtaacgggaacccggtaacgggtaccggttaacccggttaacccgtaaacggttaacccgggtaaccgtacccgggtaaaccgggtaccccgg

SEQ ID NO: 102996 - DNA, 713 bp, Homo sapiens
  misc_feature: GYAE6OF01DCQYH.3.34.D01.1.454.CMB.1.raw
tcagagacgcactccacgaccggtgctcgatttagatcgtctgtgttgggtttgggggtgggtccaggaggcagaactctgggtgtctcaccatggcctggactccctctacttcctcccctcctcactctctgcacgaggctcgtgcggcctctagtgagctcgacacacgcccaccctggtgtctagtcgtacccgaaggacacggaccggccgaggactccgacgttcgctcgtggagtacgtgctagttacggactaaagtctatacgtctacgttactggaccagacgaaggaacgccgacggtaccgcggtcccggttagggtcggtaggtagtaattacgtaaagtaaacggaccggtacggacgaccgggtaccctagggaaccggtcctaccggtacgacgtacgtacttcgtcggtcactccgaacgtcgacgacgggaacctacgaacgtccgtagtaccgaagttacgtaccggttagggttacgacggtacagggaacaaggtacggtacggacggtataaccgaaacttccgtaacgtacgttaacgaaggaaacctggtaaccgacggtaaacgcgtaaccgtaaacacggtaacgtggtaccggtggtaacggtcgggtttagggtaccgagggtaccggaaacgtccggtaccacgggttaacccacggaaaccgtcgaaacccgccggtacccgg

SEQ ID NO: 102997 - DNA, 684 bp, Homo sapiens
  misc_feature: GYAE6OF01DVS4G.3.34.D01.1.454.CMB.1.raw
tcagagacgcactccacgaccggtgctcgatttagatcgtctgtgttgggtttgggggtgggtccaggaggcagaactctgggtgtctcaccatggcctggactccctctacttcctccccctcctcactctctgcacgaggctctggacggccctcctatgacgctagacacacgcccctaccgttcggtcgtcgtacgttccggtaccccaaggaccaggacccggccgaaggactacccaccgtgcttacggtagggatagtcgactagttacggaacctaaaagtccttaagttactcgttacgttacgtacgtaacgagacgaacgacgaccgacggaccgacggtccgtgggtggtagtacgaagttaacgtaacgtacgtaccggtagacggaccggtaccgtacgtacgtacctcgacgtacgaccgtacgtcgtcgtcgcctacgcgtacgacgacgactacgtacgtacgtacgtacgactagtacgacggtacgacgtacgagtacgaaggacgtacgacgtactacgtactacgtacgtacgtaagtactaagacgacgaacgacgaagtacgtaacgtacgtacgtaggttacggtggtacggtcgggttacggtacggacgggaacgtcgacgtacccgtacgtaccgtaacacggccgacggtcgaccg

SEQ ID NO: 102998 - DNA, 705 bp, Homo sapiens
  misc_feature: GYAE6OF01EULOL.3.34.D01.1.454.CMB.1.raw
  modified_base (136)..(136): a, c, t, g, unknown or other
  misc_feature (136)..(136): n is a, c, g, or t
  modified_base (221)..(221): a, c, t, g, unknown or other
  misc_feature (221)..(221): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacngctctgaggcctctatgagctgacacagccaccctcggtgtcagtcgtcccaggacaggacggccaggatccacctgctctgganatgctagttggacaaagctatatgtacttacgtcggtaccgagcgaagaacgccgacggaccacggtccccgtggtggtgtgatagtaagtaaacggccggtagacggtacggacccgtggacgggtactccgtagacgcgtaactcgtcgtacggcctaccgaggtcctacgaacggggaacctaaactaaggttacccgtacgttaacgggacctacgtacgtacgggttacggtaccggtaccggaacggtacaaacggggaacggtaacggacgggtactaacggtacctaacgttaccgaacgttacgtaataaaacgtcgaacgaacgaaccgtaagtaactaacggtaaccggaaaccgtcggtaagggtcccggttaggtacggggtttcgggtaccgggtagggggaccggtaaccgacggtaccgtaacggttacccgtaccggtaaacggtcccgacggacccgtaacccggg

SEQ ID NO: 102999 - DNA, 766 bp, Homo sapiens
  misc_feature: GYAE6OF01AQFHX.3.34.D01.1.454.CMB.1.raw
  modified_base (232)..(232): a, c, t, g, unknown or other
  misc_feature (232)..(232): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctggaggccctcctatgagctgacacacgcccacccgtcggtgtcagtcgtccccaggacaggaccggccaggactcacctgctcgtgganatgcattggacaaagtctatatgtacttacgtcggtaaccagacacgaacgccgacgggccgaccggtccccgttggttcggggtaggttaggtaattaagtaaacgtaaaacggaccggttaggacggaacggccctacggagggtacctcccgaggtacgtacgtaactccgtcgtcgtccgtacacggtcctacggaacgggaaccctaagtacgtaccgtacgttaccgaactacgtcgaaggtacggtacgtaccggaacggacgaaggaaccggacggtaacgaccgttaaagaaccgttaactccgttaacgtaacgttaactaaaacgtaccgtaacaacggaaccgtaagaaccgtaaagggtaaccccgaaaccgtacggtaccgggttacggttaggggtagggtttaccggggacccggggtaaggggtaaccggggtaaacgtacccgggtaaccgttaacccgggtaccccgttaaacggtaaaccgtccccgggaaaccggtaccccgggtaaacccgg

SEQ ID NO: 103000 - DNA, 690 bp, Homo sapiens
  misc_feature: GYAE6OF01DJF6H.3.34.D01.1.454.CMB.1.raw
tcagagacgcactccacgaccggtgctcgatttagatcgtctgtgttgggtttgggggtcgggtccaggaggcagaactctgggtgtctcgaccatggcctggatccctctacttctcccctcctcactctctgcacaggctctgaggcctcctatgagctgacacagccaccctcggtgtcagtgtcccaggacagacggccaggatcacctgctctggagattgcattggcaaagctatatgactttacgtggtaccagacaagaagccaggccaggtcccctggtggtggtgatataagtaagaccgtgagacggccttagagggactacccgtgacgcgtaactcctacgttcggccttaccgacgtccgtaccgaacggggtacctaaacgacggtaccgtacggtttacgaaccctaagttacccgaagggttacgggaacgttacccggaagggtacgaaaggtaacgacggacgggtctacggtaactagtacctacgtaggtacctaaagtacgaccgaacgacctaacgaccgtaaagttacgggaaccctaaggttaccgggtattcggggttagggttcgggtttacccggggacgggttaacgggaacccgtaagggtcccttaacgggtaacccgttaccgttaacggaaccgtaaccggaccccgtaaaccgggg

SEQ ID NO: 103001 - DNA, 618 bp, Homo sapiens
  misc_feature: GYAE6OF01BWPUS.3.34.D01.1.454.CMB.1.raw
  modified_base (463)..(463): a, c, t, g, unknown or other
  misc_feature (463)..(463): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcagttggacaaagctatatgtctttactggtaaccagcaagaagccaggccacggcccctggtggtggtgatatataaagaccggtgagacggccctagagggtactccccgtggacgacgtaactcctcgtagggcctaccgagcctacgaagggaaccaacgacgtacctacggttacgaccctagtcgaggtagggacgtaccgaggacaaggaacgacgaggcgtagactanctactcgacaagtagacgagacgagacgaagtacgaacccgaggtacggtcgttaggtacgggttcgggtacgggacggggacgggtaacccgaacggtaccgtaccgggtaacccgttacccggtaagccggtaaccggccccggtaaaccggg

SEQ ID NO: 103002 - DNA, 758 bp, Homo sapiens
  misc_feature: GYAE6OF01AVR7L.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagaccggccaggactcacctgctcgtggagatgctattggacaaagctatatgacttacgtaggtaccagacagaacgccgaacggccgtaccggcccccgtggttgggtcgggtagattaagtaagtaaaacggaccgtagaaggacggcccctacgacggggtactccccgtggacgaccgtaactccgttcgtacgggcccttaccgacggtacctaggaacgggaaccaaacgtacggtaccgtaccggttacgaacccgtactacggtagggtacgggtacgtaccggaacggacgaaacggtaacggaaccggaagggtccttacggtaaccttagttacctaaccgttcgtaaacgtaaagttacgacctaaggaacccgaaggtaacaaaacccggttaccggaaacccgtaacggtaaggggttccgttaggggttccgggtttacggggtccggggaacggggaaacccggggtaccgaaacgggtcccgttaaccgggtaaccccggttacgttaaacggcccgtaaacccggggtccctaaacccggggg

SEQ ID NO: 103003 - DNA, 729 bp, Homo sapiens
  misc_feature: GYAE6OF01EBM5A.3.34.D01.1.454.CMB.1.raw
tcagagacgcactccacgaccggtgctcgatttagatcgtctgtgttgggtttgggggtgggtccaggaggcagaactctgggtgtctcaccatggcctggatcctctacttcctccccctcctcactctctgcacaggctctggacggccctcctatgagctgacacacgcccacccgtcggtgtcaggtccgtcccgaggacacggaccggccgaggaactccgacctgtccgttcgtagggaagtatcggtacctagttacgggaacaaaacggtacttaattaagtcgttacgtttaacgtaacggtaacccagacgaaacggaacgaccgaacggtccgaccggtccccgtgggtcgggtaggtacgtaagttaacgtaaagtaaacggacggtaaggaacggtaccggtcccgtaacggacgggtacctaccgtaggaacgtaccgtaacgttccgtcgcgtcctcgacgccgtacggaacgaacaacgtacgtacgtacgttcgaacgtatacggtacggtaggaccgtacgaacgtacgaaggtaacggacggtacggctacgtacgtactaccgtattagtaacaagtacgagaacgacgtagactaacgacggaaacgttggacggtacgttgttaacgggtcgggtcgggaaacgggtacggaacgtacggtacgtaaccggtaccggtaagtaccgtaaccgaccgtaccgtaccgg

SEQ ID NO: 103004 - DNA, 586 bp, Homo sapiens
  misc_feature: GYAE6OF01BASXV.3.34.D01.1.454.CMB.1.raw
  modified_base (179)..(179): a, c, t, g, unknown or other
  misc_feature (179)..(179): n is a, c, g, or t
  modified_base (224)..(224): a, c, t, g, unknown or other
  misc_feature (224)..(224): n is a, c, g, or t
  modified_base (441)..(441): a, c, t, g, unknown or other
  misc_feature (441)..(441): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtntcagtcgtccccaggacagacggccaggatcacctgctcgtgganatgcagttggacaaagctatatgcttactgtaccagacagaagccaggccacggcccctgtggtggtgatataataaagcgtgagacggcctcgaggactcctgacgacgaatctcgtcggctaccgacgctacgacgggacaacgtcgtacacgttacgacctatcgaggtgggtacgtaccgaggacgaaggaaacgaccggaggctagtactanacctactcgtaacgaaatcgaacacgaacagactaacgtacgaaccgaggtacggtgttaggtggttcggtaccgggagggtacgggacctaaggccgttaccgggtacccgttaccgtaaggtccgacggtcccgtaaaccggg

SEQ ID NO: 103005 - DNA, 730 bp, Homo sapiens
  misc_feature: GYAE6OF01BQTCO.3.34.D01.1.454.CMB.1.raw
  modified_base (244)..(244): a, c, t, g, unknown or other
  misc_feature (244)..(244): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctggacggccctcctatgagctagacacacgccctacccgtcggtgtcaggtccgtaccccaggacacggaccggccaggactccacctgcctcgtaggganagtcgctaagttcggaactaaagtctatagtcgtacttacgtacggacagacgaagaacgccgaacggccgacggtcccgtggtacggtggtagtaattaagtaaacgtaacggaccgtaggaacggtccgtaccctaggacggtcctaccgaggacgacgtaatccgtcgtcggtaccaccgtacggtccgtacggaacgggaacctaacggacgttaccgtaacgttacgaccgtacgtacgtaacggtacggaccgtacggaacggtaacgaaggacggaacggtagtcgtaaccgtactaccgtacgtacgtaacgtaacgaaacgtcgaacgtaacgacgtaacgaacctaaggaacccggtaactggtacgggtattcgggttagggttccgggtacgggaacgggtaaccggtaccgtacggacccggttaaccgttaccggaaccggttaacgaccggtaccccgtacggtaacccgg

SEQ ID NO: 103006 - DNA, 700 bp, Homo sapiens
  misc_feature: GYAE6OF01CJYU3.3.34.D01.1.454.CMB.1.raw
  modified_base (396)..(396): a, c, t, g, unknown or other
  misc_feature (396)..(396): n is a, c, g, or t
  modified_base (535)..(535): a, c, t, g, unknown or other
  misc_feature (535)..(535): n is a, c, g, or t
  modified_base (615)..(615): a, c, t, g, unknown or other
  misc_feature (615)..(615): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgcacgaggctctgacggccctcctatggagcctgaccacgacgcccaacccgtgggtgtacagtccgtaccccgaggaccaggaccggccgaggctccacctgactcgtggatatcgactagttcggaacaaagcttatacgtgtactttaccgacgtaaccagacaacgtaacgccgtacgcccgacggtcccgtggtgggtagagtattaagtaacgtaacggtacgtaggacggaccgtcccgaggacggtcctacggngacgacgtactgtcgacgtcgacgtacgccgtacgacgaccacggtcgtaccgtagtacgtacaggtacgtagcggacctacgaggagtaacgaggacggtcgactacgtactacgtactactagtaaacagggtaacngaaccgttacgaacgtaaccgagtaaccgtacggaaggtccggttagttcggtggggttaccggaccgggggaaaccggngggaaccctttaacgggcccctttaacgggtaacccccgtttaaggaccctaacccccggtagggtaacccccgttaacccgggg

SEQ ID NO: 103007 - DNA, 833 bp, Homo sapiens
  misc_feature: GYAE6OF01BGBCB.3.34.D01.1.454.CMB.1.raw
  modified_base (226)..(226): a, c, t, g, unknown or other
  misc_feature (226)..(226): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggactccacctgctcgtgganatgctagttggacaaagctatatcgtacttactacggtaccacgacaagacgaccgacggaccgaccggtccccgttggtgggtaggtagtaattaagttaagtaaaacggtaccggtaggaacggaccggtaccccgtacggaacgggtaccttaccccgtaggaaccgtacggtaacttccgtacgtccgggtacccgttccacggtaccgttaccggaacggggtaaaccaaacgtacggttaccgtaaccggtttacgaacccgtagtaccggtaacgggtacgggtaaccgttaccgggaacggaccgaaagggaacggaccggtacgggacgttagaaccttacgtaccgtacttacggtaactaaacgtacgaacccgtaagaaccgaacggtaaaccgtaaacgggtaaccggtaaaaccccgtagggttaccgggggtacggttacggggtttaccgggggttaccggggtttaccgggggaaaccgggggtaaacccggggtaaacccgaaccggggttccggttaacccccggttaacccgggttaacccgttaaaccggggtacccgaacccgggtaacccggtaaaccccgggg

SEQ ID NO: 103008 - DNA, 1056 bp, Homo sapiens
  misc_feature: GYAE6OF01E2PRD.3.34.D01.1.454.CMB.1.raw
  modified_base (325)..(325): a, c, t, g, unknown or other
  misc_feature (325)..(325): n is a, c, g, or t
tcagagacgcactccacgaccggtgctcgatttagatcgtctgtgtttggggtttgggggtggtccaggaggcagaactctgggtgtctcaccagtcggcctggactccctctacttcctccccctcctcactctctcgctacgaggctcgtggaccgtcctcgtatcgacgctacgaacacgaccgcccctaccgtcggtcgtaccgtacgtcccgtacccggaaggacccgaacgggtaccggaccgaacgggtacctccctacccttgtccgttacggtagggaattcgttacgacgtacgggttacgggaactaaaacgtnttaacgtacggtttaccggttaccgttaacggttacccgggaacctaacggaaccgaacggtaaacccgggtacccggtaccggtaacccccggttacccgggttccccggtttaggggtttagggggttaccggttaaacggttaaaacttttaaaacgtaaaaccggggtaaacccggttccgggttaacgggaaacccgggtaccccgggttaccctaaccgggggtaacggtccccgttaccccggtaagggtaaaccgtaccggggtttaaccttcccggttaacccggtttccggaaccccgttcccgggaaacgttacccgggtaaacggggttaacgtaaaaccccgggttaacgtaggttaaaccccgggtacctttaaacggaaccccggttttaaggtacccgggttaaacgtaacccggggtacctaaacccggggtaaacggttcgggaaaacgggttaccgggtaaccgggtacgggttaaccgtaccggtttaacctaacccgggttactaacgggtttaacctaacgggtaacgaaggtaaacccgtacggaaacgttaacgttaaaccgtacgggtaacccgaaaccggtttcggggaacgggttacggggtcccgttaggggttccccggggcggaaagggacgttaccgtaaccgggtaccccgtaacggttaaccccgttgaaacccggttccgcccggaacggttccccg

SEQ ID NO: 103009 - DNA, 739 bp, Homo sapiens
  misc_feature: GYAE6OF01CD7J8.3.34.D01.1.454.CMB.1.raw
  modified_base (235)..(235): a, c, t, g, unknown or other
  misc_feature (235)..(235): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgacgcctcctatgagctgacacacgccctacccgtcggtgtcacgtcgtaccccgaggacaggaccggccaggactccactgctcgtgganatgactagttaggacaaagtctatatgtaccttacgtcggtaccagacgaagaacgccgacggcccgaccggtccccgttaggtgggttaggtacgtaagttaataaacgtaaacggtaccggtaggacggtaccggtccccgtacggaacgggaccttacccgtaggaccgacgtacttccgtcggtcgcctaccacggtccgtacggaacgggaacaacgtacggtaccgtaacggtcgtaacctacgtagacgggtgggaacgtaccgaggaacgaacggaacggacggacgtacgtacgtactactacgtacgtagtaacaacgtagacgaacgaacgtagaaccgtaacggtacccggaaccgtaggtaccgggtggttacggggtacggggttacggggttaccggggaacgggtaaaccgggtacggaccggttaccggttaccggtaacccggttaacccgtaacggtacccggaacccgggtcccgtaacccggg

SEQ ID NO: 103010 - DNA, 816 bp, Homo sapiens
  misc_feature: GYAE6OF01EGG7V.3.34.D01.1.454.CMB.1.raw
  modified_base (222)..(222): a, c, t, g, unknown or other
  misc_feature (222)..(222): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtctcccaggacaggacggccaggatcacctgctctgganatgctagttggacaaagtctatatgtcttacgtacggtaccagcaagaacgaccgacggccgacggtcccctaggttcggtggtagtattaataagtaaaacgtaccggtaggaggtaccggtaccctacggaagggtacctccgtaggacggtacgtaacgtccgtcgtacggtcctaccgacgtacgtacggaacgggtaaccaacgtaggtaccgtacggtttacaccgtactacgtaacggttacggaccgttaccggaaggacgaaacgggaaacgggaccgggtaacgggtaccgttaacgtaaccgttaacgttaacccggtacgtttaacggtaaaccgttaaaagttaaccggaaccgaaaccgtaacgggtacgtaaaccggttaaacggtacccgggtaaaacccgtaacgggttaaggggtccgttttaacggggttccggggtttaacggggtttacccggggggaacggggtaaacccggggtaacgtaaacccgggttaccccggttaacccgggttaaccccgttaacgggttaacccggtaacccggtacccgggaaccccgggttaaaccccgggg

SEQ ID NO: 103011 - DNA, 756 bp, Homo sapiens
  misc_feature: GYAE6OF01CTM4M.3.34.D01.1.454.CMB.1.raw
  modified_base (143)..(143): a, c, t, g, unknown or other
  misc_feature (143)..(143): n is a, c, g, or t
  modified_base (145)..(145): a, c, t, g, unknown or other
  misc_feature (145)..(145): n is a, c, g, or t
  modified_base (244)..(244): a, c, t, g, unknown or other
  misc_feature (244)..(244): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgcacgagctcngnggcctctatgagctacgacacacgcccaccgtcggtcgtcaggtccgtacccgaaggacacggaccggcaaggtactccgaccgtgcgtacgtgggaancgtagactagttcggaacaaagtctattacagtacttaacgtacggtaacgagacgtaacgaaccgaccgacggacccgtaccggtccggttggtgggtacggtagtaaataacgtaaacggtaaacggtaccggtacggaacggccggtaccctacgggaacggtccgttaccggacggacgtacgtaacgttcgtacgtcgaccgtaccgtacgtccggaacggaacgggtaacaacgttacgtaccgttaccgtaacgaccgtaacgtcggtacggtaccgggtacgaacgggtacggacggaaggtaaacgggacggtacggtacgtaacgtacgtactacgggggggtactacgtaacgtaacgtaacgacgtaacgacgacgaacgtaacgtaacgtacgacggtacggtacggtacgggtgggtacgggtaccgggtacgggtaaccggaacgtaccgtaccgttaccggtaccgtaacgacgaccgacggtacccggtacccgg

SEQ ID NO: 103012 - DNA, 750 bp, Homo sapiens
  misc_feature: GYAE6OF01AWE81.3.34.D01.1.454.CMB.1.raw
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
tcagagacgcactccacgaccggtgctcgatttagatcgtctgtgttgggtttgggggtgggtccgaggaggcagaactctgggtgtctcaccatggcctggatccctctacttctcccctcctcactctctgcacagctctgacggcctcctatgagctgacacagcccacccgtcggtcgtcaggtcgtaccccaggacacgaccggcgaggactcaccgtgccttcgtcggagtatcgcacgttacggactaaaacgtctaagttacgtagtcctttaaccggtcggtaaccgaaggtccgaacggaagaccgacggacccgtaccggccccgttaggtgggtacggtgtaagtaatacgtaaacgacgttggaacggaccggccgttanaacgggccttaccgnggtacgacgtaaactcgtaccgtcggacctacgtcgaccgtacggacggaaccgtaacgaacgttacgtaccgtcgaaccgtgtacgtacggtacggaccgtacggaacgacgtaacgaaacggcggacgtactccgtaactacgaccttaacgtactaacgtaacgacgtaccgaaacgaccgtaacggaactaaccgggtaaaccgaccgggtaaacgttcggtaaccggttaggggttggttaccgggtaaccgggggtacggaccggggtaaacggaacgtcgggaacccggttaaccgaccggtttaaaccgcccgttaaacggccccggtaaacgg

SEQ ID NO: 103013 - DNA, 713 bp, Homo sapiens
  misc_feature: GYAE6OF01B9ZY9.3.34.D01.1.454.CMB.1.raw
  modified_base (180)..(180): a, c, t, g, unknown or other
  misc_feature (180)..(180): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggccctcctatgagctgacacagcccaccctcggtntcagtcgtccccaggacaggacggccgaggactccacctgctacgtggagatgctagttggacaaagtctaatagtgtacttacgtacggtaaccagacaaggtaacgccgtacggacccgaccggcccccttgggtacgggtcggtagtaattaagtaaacgtaaaacggaccggtaggaacggaccggcccctaggaacgggtaccttccccgtaggaacgaccgtaattccgtcgtcgggtccctaccgacgtccgtacggaacggaacctaacgtacgtaccgtacgttacgaccgtaataccggtaggtacggtacgtaccgaggtaactaaacgggtacggacgggtaagtccctaacgtaaccttactaccgtagttacgaaccgtaaagcgtacgaacgaacgtagtaccgtaaacggtaccgaacccgtaggtacggtcgtcgggttagggtcggttaccggggacggtaacggtccgacgtcccgtacgtaccgtaccgtagaccggaccgacccggtaccgg

SEQ ID NO: 103014 - DNA, 959 bp, Homo sapiens
  misc_feature: GYAE6OF01BRISS.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacagctctgacggtcctctatgagctagacacacgcccacccgttcggtcgtcacggtcgtaccccgaggaccgacggaccggcggtaagacgtaccaccgttcgcctaccggtagggaagtacttcgacgtacgttacgggaacaaaacgttcttaattagttcgttacgttacggttaccggtaaccgtaacgacgtaacgaacgaccgacgggtacccgaccggggtcccgtgggttacgggtacggtaacggtaagtttaaacgtaaaacggtaaaccgggtaccggtacggaacgggtacccggtaccgtaacgggtaaccgggtacccgttaccggtaaggtaacgaaccgttacgttaccggtacggttccggtacctaccggtacgtaaccggtacgggaaccggtaaaccgtaccggtaacgttaaccggtaaacgttaccgaaccgttacggtacgggtaagggttacgggaccggttaaccggggaacgtaaacgggaaacgggtaacgggaaacccgggttaggtaaccggtaacggtaaaccttaacggtaaccgttaccggttaacgtaaaactaaacggtacggaaaccggaaccgttaaccgggaaagtaaacccggtttaaacggaacccgggtaaacgtcggggtttaaacgggtaccggttcgggttaacgggggttaccggggtaaccggggtaaacccggggtaaccggggtaacccggtaaacgttacccgggtaacccgggttaaccccgtaacggttaaccgggtaaccccggtaaaccccggaacggggttaacccccgg

SEQ ID NO: 103015 - DNA, 739 bp, Homo sapiens
  misc_feature: GYAE6OF01BCNA9.3.34.D01.1.454.CMB.1.raw
  modified_base (225)..(225): a, c, t, g, unknown or other
  misc_feature (225)..(225): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgcagttggacaaagctatatcgcttacgtggtaaccagcagaacgccgagccacggcccctgtcgggtggtgatataataaacgaccggtagacgacggcccctcgacgggtacctccgtaggacgcgtaactccgtcgtcggctccgaacgtccgtacgaacgggaccaacgtacgtccgtacggtttacgaacctacggtcgtaacggtcgggtaccgtaccggaggacgaacgggacggtaaccggagggtacctacggtaacttacgtaccgtacgttacgtaaacctaaacgttaacgaccgtaaacggaaccgtaacggtaaccgtaaacgggaaccggtaaaccccgtagggttaaccggggtccgttaggggtttacgggttccgggttaccggggggacccggggtaaaccggggtaacccgaaaccgggttcccgttaaccgggtaaaccccccggtttacggtaaaccgtcccggtaaccggtaccccggtaaacccgggg

SEQ ID NO: 103016 - DNA, 779 bp, Homo sapiens
  misc_feature: GYAE6OF01C4625.3.34.D01.1.454.CMB.1.raw
  modified_base (240)..(240): a, c, t, g, unknown or other
  misc_feature (240)..(240): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgacggccttctagtgagctgacacacgcccaccgtcggtgtcagttccgaccccgaggaccacggaccggccaaggtactccacctgctcgtgganatgactacttaggaactaagtcttaagtactagtaccgttacgttacggaccagacgaaggaccgaccggaacggccgtaccggtccccggttgggttacgggtaggtacttaaagttaacgtaaacggttaaaccggccggtaggaacccggtacggtacccgtagggtaacgggtaccttaccggtaggaccgtaaccgtaacgttcgtaccggtacgccgtaacgcgtacctacggaacggacctaacgacgttaccgtacgtacgacgtacgtcgtaggacgttacgaccgaaggacgtaacgggacggaagtacggtcgtaacgaacgtactaacgtacgttaacgaacgtaagtacgagtaaacacgtacggaaactacgttaaccggaacgtacgggttacggtaccggttcggttaacgggttacgggtacccgggggtaaggaaccgggtaacccggtaacgttacgggttaacccgtaccggggttaaaccgtacgggtaaccccgacgggtacccggttaaccccggg

SEQ ID NO: 103017 - DNA, 885 bp, Homo sapiens
  misc_feature: GYAE6OF01EQ6K3.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctggacggcccttcctatgacgtctagacacacgcccacccgtcggtgtcagtccgtacccgaggacgacggaccggccgaggactccgacctgccgttacgtagggaatagtcgacgtagttacggacctaaaagtcttaatacgttgtaccttaaccgtcggtacctacggacaacggaaccgaccgacgggcccgtaccggtccccgttgggttcgggtggtagtagttaacgtaaacggtaaaccggtaccggtaaggacggtacccgggtaccccgtacggaacgggtacccgttaccggtaggaccggtaccgtaacgtttccgtaccggtcggtaccccgtccgtacggtaaccggtaaccgggaaacggtaaacccgtaaaccgtaaccggttaccggttaacccgggtttaaccgaccttacggtacggttaacgggtacggtaacgttacccgggaaacggaaccgaaaggggtaacggaccgggtaacggccgttaacggtaccttacgtaccgttaacgtacgtaaaccgtaagtaaccgacgtaaaccgacgtaaccgtaacgttaaaccggaaccggtaaacccggtgggttaaccgggtacggtttcgggttaaccgggttcggggtacccggggaagggtaacccgggtactaccgggtaacggttaccccgggtttaaccgtaaccgggtaacgacccggttaaaccccggtaccggtaacccggg

SEQ ID NO: 103018 - DNA, 723 bp, Homo sapiens
  misc_feature: GYAE6OF01CS60F.3.34.D01.1.454.CMB.1.raw
  modified_base (707)..(707): a, c, t, g, unknown or other
  misc_feature (707)..(707): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgcacaggctctgacggcctctatgagctgacacacgccaccctggtgcagtctccccgaaggacacggacggccaagggactaccacctggcctcgtgggaagtatcggactagtttcggaactaaagcttatagtcgtactttacgtaggtaaccgagacgaacgaacgaccgacggacccgtacggtccccgttggttcggggttggttaacggtaactaagttaaacgtaaaacggaaccggtaggtaacggtaccggtacccgtaacggtacggtaccgtacccgtgaacgacgtaacgtccgtacgtcgggtaccttaccgacgtaccgtacggaacggaacaaacgtacgtacgtacgttacgacctaatacgtaggtacggtacgtacgacggtaccaaaggtaaacgaccggacgtacgtacggtaacctactaacgtaacgtacggtaacttaaacggacgtaacaagaaccgtaagacgtaaacgtaacggtaacccgaggtacggtagtggttcggtacggtacgggacggtaggaacgacgtacgtacgtacctaacgtanacgcgaccgtaaccgg

SEQ ID NO: 103019 - DNA, 796 bp, Homo sapiens
  misc_feature: GYAE6OF01EDP48.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccacccgttcggtgtacagtcgtccccgaggacaggacggccaggactccacctgctcgtaggatatgctagttggacaaagtcttatagtcgtacttacgtacggtaccagacgaagaacgccgacggaccaccggtccccgtgggttcggtggtagtaagttaagttaagtaaacggtaccggtaggaacggtaccggtacccgtacggaacgggtacctaccggtaggacgtacgtaacttccgtacgtcggtcctacgacgtctacggaacggaacaacgtacgtacctacggttacgaacctagtacgtaggtacggacgtaccgaggacgaacggaacggaacggacgtacgtaacggtaacttaactaccgtaacgttaacgtaacgtaaagtacggaacaaacggaccgtaaacggaaaccgttaaacggtaacccgggtaaacccgtaacggggttaccgggtacggttacggggtttaccggggttaccggggttacccggggaaacggggtaacccgggtaaacccgtaaccggggttaccgtaaacccgggttaaccccgttaacccgggttaaaccggtacccggtaaccccggtaacccgggtaaccccggg

SEQ ID NO: 103020 - DNA, 709 bp, Homo sapiens
  misc_feature: GYAE6OF01DEPRI.3.34.D01.1.454.CMB.1.raw
  modified_base (79)..(79): a, c, t, g, unknown or other
  misc_feature (79)..(79): n is a, c, g, or t
  modified_base (238)..(238): a, c, t, g, unknown or other
  misc_feature (238)..(238): n is a, c, g, or t
  modified_base (473)..(473): a, c, t, g, unknown or other
  misc_feature (473)..(473): n is a, c, g, or t
tcagagacgcactccacgaccggtgctcgatttagatcgtctgtgttgggtttgggggtgggtccaggaggcagaactntgggtgtctcaccagtggcctggatccctctacttcctccccctcctcactctctgcacaggctctgacgcctctatgagctagacacacgccaccctggtgtcaggtcgtcccgaggacacggaccggccaggactccaccgtgccgtacgtaggganactgactagttacggaacgtaaagtcttaatgtacgtacctttacgtacggtaaccaaggacctaaggaaaccgtacccggaacggtccccgtaacgggttccccgttagggtttggggtagggttaataaagttaacgttaaaaggtaaaccggtaacggttacgggaacgacccgggtacccttcggaacggtactcccgtaagcgacgttactcgtcgtacgcctacgtacncgtacgaggaacaacgtcgtagtacgttacacgtatacggacgtgacgacgacgacgaagaagacgagacgtagtactactacgtactacgtaagtaatacgacgaagtaacgagaacgtacggaaccggaacctaggtaccgggttagtcggggtttacggcgggtaccgggagggaacgggtacgaacggtaccgtacgtacccgttaacgcgtaaccgacgtacccggtaccg

SEQ ID NO: 103021 - DNA, 805 bp, Homo sapiens
  misc_feature: GYAE6OF01BMK0I.3.34.D01.1.454.CMB.1.raw
  modified_base (358)..(358): a, c, t, g, unknown or other
  misc_feature (358)..(358): n is a, c, g, or t
tcagagacgcactccacgaccggtgctcgatttagatcgtctgtgttgggtttgggggtgggtccaggaggcagaactcgtgggtgtctcaccatggcctggactccctctacttcctcccctcctcactctctgcacaggctcgtggacggcctctatgacgctagacacgacgccctaccgtcggtcgtcacgtccgtacccgaggacgacggaccggaccgaggacctccaccgtggtaccttcgtagggatacggtcgacgtagttacggaacaaacgtacttagtatcgtacgttacgtacggtacagacgaagaacgccgacggaccacggtccgttgggtacggtggtaanacgttaagtaacggtaacgtacggtagacggtacgaccgtaggaacggtacctcgaggacgtacgtaactccggtacgtcggtaccgaccggtaggtccgtacggaacggtaacctaacgtacggttaccgttaaccggttacgaaccggtaacgttcgggtaacggtacgggttaacccgaacgggtacggtaaacggaaacggttaaccggaacgggaacgttaccggtaagtaaccgtacgacgtacgtacgtaaacaaggtccgaacgaaactaccgagtaaaccgaacggttacccgaaacggttcggggtaacggttacgggttaggtaccgggggttcgggtaaacccgggggagggaaacccggtacgggacccggttaccgtaaaccgggtaccccggtaacgttaaacgggaccccggaccggtaccgggttaaccg

SEQ ID NO: 103022 - DNA, 727 bp, Homo sapiens
  misc_feature: GYAE6OF01EQ3ZF.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgacggcctcctatgagctgacacacgcctacccgtcggtgtcagtcgtaccccgaggacacggtaccggccaggctaccaccgtgccttgtacggatagttcgacctagttacggaccaaagtccttaagtagttcgtaccttacgtacgggttaaccacgtacgagaacgccgaacggcccgtaccggcccccgttggtcgggtggtagtaacgttagtaacgaaaccggtcggacgtaaggacccgtccctaacgggtaggtacccgtccgaggacgacgtactcgtcgtacgtcctacgacggtacctaacggaacggtaaccaacgtacggtaccttacggactaccctagtacgtaggttccgaggtaccgaacggtaacgacggtagaccgaggtacgtacgtacaccgtacgtctaacgttacgaacgtacgacgacggtaccaaacgtacgtaaccgtacggtaaccggtagtacgggtcgtaggttcggggtcgttaccgggggaacggacgggacccttacggaaccgttcccggaacggttacccgaaggtcccgaaaccggtccgtacccgg

SEQ ID NO: 103023 - DNA, 903 bp, Homo sapiens
  misc_feature: GYAE6OF01DZUXZ.3.34.D01.1.454.CMB.1.raw
  modified_base (182)..(182): a, c, t, g, unknown or other
  misc_feature (182)..(182): n is a, c, g, or t
tcagagacgcactccacgaccggtgctcgatttagatcgtctgtgttggggtttgggggtgggtccaggaggcagaactctgggtgtctcaccagtggcctggatccctctacttctcccctctcactctctgcacgaggctcgtgacggccttctatgagctgacacagcccaccgtggtntcagtcgtacccgaggacacggacggccaaggactcgacctgcgtcgtgggaatatcgtactagttcggaacaaaacgtctagttacgtcgtacttacgtaccggtacacgacgtaaacggacgtaccgaggtccgacggtcccgttggttaggcgtagtactaagtaacgtaaggacggtagacggtacgtccgtcgaaggtcctccggtagacgtacctaagttcggtacgtcgacgttaccgacggtaccgtacggaacgggaactaaccgtcgttaaaccggccgtttacgaaccgtagttaccggtacgggtacgggtaacgtaccgggacgggaacggtaaacggacgggtaacccgtaaggtaccgttaacgggtaacctttaccgaaccgttaaccggtagttaaaaccgaacgggttaccaaaccggttaaacgaacgaacgggtttaaaccggtaaaaccgtaaccccggggtaaaccgttaacgggggttacgggggtaccgggttttaacgggggttaaacccgggggtttaaccggggggttaaaaccccggggggtaaccggggggtttaaaacccggggggtaaccctttaaaccccggggggttaacccccgggttaaacccgggtttaacccccccgggttaaaaacgggtttacccgggaaccccggggtaacccgggtaaaccccccgggttacccccgggg

SEQ ID NO: 103024 - DNA, 706 bp, Homo sapiens
  misc_feature: GYAE6OF01EUSO9.3.34.D01.1.454.CMB.1.raw
  modified_base (232)..(232): a, c, t, g, unknown or other
  misc_feature (232)..(232): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatcgagctagaccacacgacccacccgtcggtgtccagttcgtcccccaaggacaggaccggccaggactcacctgctgnggagatgcattggacaagtctatagtcgcgttaactcggtaccaggacaaggagccacggccgaccggtccccgttaggtggtggtagaattaagtcaaaagtaacccggtcgaacgaggacccgtcctacgggaagtccctcgtagtccggtaacgtactctcgggtcgtcccaacgacgtctaagggaccgaaacacggtacgaccgttaggacccaagtccgtaagtcgggaggtaccaagggacgagacgaacgttcgggactcgacgtacttacgactacgttacgaaacttaggaccaggaacctaacgtacgaaacctagggaaacccgaacgttaaggggtaccgtaacggttcgggtaccgggttaacggggtaacccgggtaacgggtaaaccggtacgtaaacgggtcccgtaaaccggttaccgggaaccgtttaaccggtacccggacccgtaaccccggg

SEQ ID NO: 103025 - DNA, 787 bp, Homo sapiens
  misc_feature: GYAE6OF01BU4ZP.3.34.D01.1.454.CMB.1.raw
  modified_base (137)..(137): a, c, t, g, unknown or other
  misc_feature (137)..(137): n is a, c, g, or t
tcagagacgcactccacgaccggtgctcgatttagatcgtctgtgttgggtttgggggtgggtccaggaggcagaactctgggtgtctcaccatggcctggactccctctacttcctcccctcctcactctctgcanggctctgagcctctagtgagcgtagacacgacgccctacccgtcgggtatcgacgttcgtaccccgaaggaaccgaggaccggccgaaggactccaccgttgctcgtaggacgtagtgacctaaggttcggaactaaaacggtctttaagtacgttacggtaccgttttaacggtacggtaaccgaacggaccgaaacggaaccgacccggtacgggacccggtacccggtacccggtttaggttggggttagggtaagttaacgtttaaacggttaaacgtaaaaccgggtcccgggttaaggaaccgggtaccggtaccccgtacgggaacgggtaccctccggtaaggacggtacgtaacttccgtacggtcgtacccgtacgacggtcgaacggtaacgggaaccaaacgtcgttaacccgtacggttaaccgactaacgtcgtaaaaacggtcggtacgtaccggaacggtaacgaacgggaacggtaacggacgtacgtacgtacgtacgactacgttaacaacgaacgaacgacgacgaacgacgacgaacgaacgacgtagtacggtacgttcggtaggtacggtacgggacgggacggacgacgtcgtaccgtaccgtacgtacgacgccgcggtacccgg

SEQ ID NO: 103026 - DNA, 699 bp, Homo sapiens
  misc_feature: GYAE6OF01BJ0EQ.3.34.D01.1.454.CMB.1.raw
  modified_base (132)..(132): a, c, t, g, unknown or other
  misc_feature (132)..(132): n is a, c, g, or t
tcagagacgcactccacgaccggtgctcgatttagatcgtctgtgttgggtttgggggtggtccaggaggcagaactctgggtgtctcaccatggcctggatcctctacttctcccctctcactctctgcanaggctcgtgacggccttctatgagctagacacacgccaccgtgtgtcagtctcccgaggacacggacgccaggatccaccgtgtctcgtaggagtactgactagtggaacaagtactatagtcgtacttacgtcgtacagcgaagacgacgacggccgtacggcccgttggtggtggtagacttaagtaacgtaacgacggagtacgacggtcctgaacggtctccgtgagctatcctcgcgtaccacgtacgctacgacggaactaacgtcgtacacgttacaacgtcgttaacggacggtacggtacgtacggacggaagaaacggtaacgaaccggtcgtaacgtacgttaaccgtacgttaaccgtacttaaacggtaacctaaacggacggtaaccaacggaaccttaaacgacggtaaacgtacccggtacgtaacgttacggggtagtttacgggttacggggttcgggtaccggaagggggtaccggtacgtaaaccggttcggttaacccggtacgttaacccgttaccggtaaccggaaccgtaccggtaaccccgg

SEQ ID NO: 103027 - DNA, 717 bp, Homo sapiens
  misc_feature: GYAE6OF01CX3Q7.3.34.D01.1.454.CMB.1.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (469)..(469): a, c, t, g, unknown or other
  misc_feature (469)..(469): n is a, c, g, or t
  modified_base (559)..(559): a, c, t, g, unknown or other
  misc_feature (559)..(559): n is a, c, g, or t
  modified_base (657)..(657): a, c, t, g, unknown or other
  misc_feature (657)..(657): n is a, c, g, or t
tcagagacgcactccacgaccggtgctcgatttagatcgtctgtgttgggtttgggggtggtccaggaggcagaactcgtgggtgtctcaccagtcggcctggactccctctacttcctcccctcctcacctctctgcacgacggctcgtggacggtcccttctagtggacgcctagaccactgccccacccgtgggtctacncgtccgtacccgaggacaggccgccgaggtactccaccgttgcgttcgtaggaatagcgacgtagttacggaacaatcttagtntcgtactttacgaggacacgacgtacgaacgtccgacgaccgccggtcccgttaggtggttaggtacaagttaagtaacggtaaacgtcggtagacggtccgtaccgtggtaacggcctaccgtgacgtacgtctcgtcgtactccgactaagccgtaaggaacgactaacggagttaccgngtactaccgagtacggtaggacggttacgacgacggtaaccgaaggaacggcgcgggtaactcggttaacaggttaccagttaaccgaanacggttcaaggaccaagggttacaaccgtacgtaaacgaccgttagggcccggttaagtcgggttttccgggaaggttcccggggaaggggttaaccncgtacggtaaccctcgggttaaccccgaagttccgaaccggaccggcccgttaacccggg

SEQ ID NO: 103028 - DNA, 734 bp, Homo sapiens
  misc_feature: GYAE6OF01AIX11.3.34.D01.1.454.CMB.1.raw
  modified_base (248)..(248): a, c, t, g, unknown or other
  misc_feature (248)..(248): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctggagatgcattggacaaagctatatgcttacnggtaccagcagaacgccacggccacggtcccctagtggtggtgactagtaataaaacggccgttagacggacggcccctggacgggactccccgtggaacggcgtaacgtccgtacgtggtccctaccgacgcctacggaacgggtaccaaaccgtaggtaccctaaccggtttacgaacccgtacgttacgtaggtacgggtaacggttcccgaagggaccgtaagggaaaccggtaaccggtaacgggtacgttacggtaacttaacgttaccgtaacgtttaacgtaaccgtaaaagttaccggactaaccggtaacgaaacggtcctaaaacggtacccgggaaaacccgtacggttaacggggctttaacgggtgggttacggttaccgggggtacgggaacgggttaccgaacgggtcccgttacgggtaaaccccgttaccgtaaccggttaccgtacccggtacccgtaaacccgggg

SEQ ID NO: 103029 - DNA, 662 bp, Homo sapiens
  misc_feature: GYAE6OF01DZ432.3.34.D01.1.454.CMB.1.raw
tcagagacgcactccacgaccggtgctcgatttagatcgtctgtgttgggtttgggggtgggtccaggaggcagaactctgggtgtctcaccgatggcctggactccctctacttcctccccctcctcactctctgcacaggctctgacggcctctatgagtctcgacacacgcccgtacccgttcggtcgtcgacgtccgtaccccgaaggacacggaccggaccaggactcccacgtgtcttcgaggactatcgactaggttacggaactaaagtcttaatcgttacgttacgttacggtacgacgagacgaacgacgaccgacgccgtcgtccgtggtggtagtatagtaagtaagaacgtcgtagacggaccgtacgtagacgtactacgagtacgtactctcgtcgtcgtccgtactacgacgtacggacgtacgtacgtacgtacgtacgtacgtacgtacgtacgtacggtacgtacgacgagaacgaaggacgtacgcgtactacgtacgtacgtacgtaactagtaacgacgtacgacgtaacgacgtactaaccgaacggtacgaggtacgttcggtcggtacggtacgggtacggacggacgtacggtacgaccgttcgaccgtacgtacgacgaccgaccggtccgtccg

SEQ ID NO: 103030 - DNA, 1069 bp, Homo sapiens
  misc_feature: GYAE6OF01ADVY9.3.34.D01.1.454.CMB.1.raw
  modified_base (166)..(166): a, c, t, g, unknown or other
  misc_feature (166)..(166): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgccacaggctctgacggtccctactatggacncgtacgacaccgacgaccctaccccggttcggttacgtcctaggtcccggtaccccgaacggacgacgggaccggacccggaaggtaccttacctaaccgtcggtccttaccggtagggacgtagtacggaccttaggttacgggaaactaaacggtacttaagttacgttcgtttaccgtttaacggtacggtaaccgaacgtaacgaacgaacccggaccggaaccggacccggaccggttccggttacggggttagggttaggggttacgtaagttaacgtaaaacggttaaaccgggtacggtaccgggtaaccgggacccggtacccggtacgggtaaccggtaccgttacccccggtaagggaaccgttaccgttacgttaaccgttccggttaccggtacccgtaccggtacccggaccgttaaccgggaaaccggtaaaccgtaaacccggttaaccggtaaccgtttaaccggttaacccgggtaacctaccgggttaaccgtacgggttaaccgggtaaccgttaaacccgggaaaggtaaacccggttaaaacgggaacgggtaaacccgggtaaccgggttaaccgtttaaaccgtaacccgtttaaacccgttaaccggtaaaccggttttaaacctaaccgggttaaactaaccggaaccggtaaccggaaaaccgttccgaacccggttaaacggtaacccgggtaaccccggttaggggttaaccgtacccgggttagggggtttacccgggttaacggggaccggggttaaaacccgggaaccggggtaaaccgggtccccgggttaaaccgttaccccgggttaacccccggttaaacggggtaaccccgttcggggtaaacccgtaaacccccggggtaaccgg

SEQ ID NO: 103031 - DNA, 696 bp, Homo sapiens
  misc_feature: GYAE6OF01CM4TX.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctggagatgcagttcggacaaagctatatcgtcttacgtggtaccagacaagaacgccgacggcccgacggtcccccgtggttgggtgggtagtaattaagtaagttaaaacggacccggtaggaaggacggtccccgtacggaacgggtacttccccgtaggaacgaccgtaacttccgtcgtcggtcccttaccgacgtccgtacgaacgggaacctaaacgtacgtaccgtacgttacgacctagtaccgtaggtaggacgtaccgaaggacgaaaggaaacggtacggacggactacgtaactactacacgttacgtaactaaagtacgacgtaacgaacgagaacaaacggttacggaacccgtaaggtcgggtacgtttgggtagggttccggttacggggacgggaacgggaaccgaaggtcccgtacggtacccgttaacgtagtacccgaacgggtcccgtaaacccgg

SEQ ID NO: 103032 - DNA, 1096 bp, Homo sapiens
  misc_feature: GYAE6OF01D7DD0.3.34.D01.1.454.CMB.1.raw
tcagagacgcactccacgaccggtgctcgatttagatcgtctgtggttgggtttgggggtggtccaggaggcagaactcgtgggtgtctcaccagtcggcctggactccctctaccttcctcccctctcacttctcgtgcacgagtctgaggcgtcctacgtagtcgacgtcgtaacgacgtaccgaccgtccccgtaccggtcggttcgaccgttccggtcccgtaaccgaaggtaaccggacggaccggaccgtaagtaccgtacctacgttcgtcgtccggaaggtagtacgtcgtaacgtacggttaacggaactaacgtcgtttaacgttacgtcgtttaccgtaacggtaccggacgaacgacggaaacggaccgacggaccggacccggttacccggttcggtagggttacggttaggtaaactaactttaaaaccggtaaacggtaaaccggtcggtacggtaaccggccgtaacccggtacgggtaacccgtaccgtaccgggtaacggtaaccgttaccggtaccgtttacccggttacgtcccggtaaccgttaacgtacccggttaacgggaacggttaaaaccgggaccgtttaaaccgttaccgggttaacggtaccgttaaccgtaccggttaacgggttaccgtaacgggggttaacgtaccggggtaaaccggaaacgggttaaaccgacgggttaaaacccgggttacgggtaaccggttttaccgttaaaccggttaaccgtttacccgttaaacggtaacgtttaaaccggtaaaccgtaaaccgggggccttaaaacgggaccggtaaaccccgttaaagggtaaacccgtttaaacccggggtaaacggggtttaaccgggttaaccgggtacgggggttttaaccccggttttaggggggaaccccgggggtttttaccgggggtaaacccggggggaaacggtaaacccccgggtttaaccgggttaaccccgggtaacccccggggttaaccgggtttaacccccgttaacgggtttaaaacccggggaccggtttaaccccccgggggttaaaacgggttccccccgggg

SEQ ID NO: 103033 - DNA, 743 bp, Homo sapiens
  misc_feature: GYAE6OF01AET4P.3.34.D01.1.454.CMB.1.raw
  modified_base (242)..(242): a, c, t, g, unknown or other
  misc_feature (242)..(242): n is a, c, g, or t
tcagagacgcactccacgaccggtgctcgatttagatcgtctgtgttggggtttgggggtgggtccaggaggcagaactctgggtgtctcaccatggcctggatccctctacttcctccccctcctcactctctgcacaggctctgaggcctcctatgagctgacacacgcccacccgtggtgtcgagttcgtccccgagggaccacggaccggccgaggactccaccgtgactcgtagganatcgacaagttcggaacaagtctagttatcgtacgttacgtacggtaaccagaacaaggaccgaccgaacggacccgtaccggtaccccgttgggttacgggtggtaaggtaaacttaacgtaaaacggtaaaaccggtaccggtaaggaacgggtacccgggtacccctacgggaaccgggtacctaccccggtagaaccggacgttaactcgttacggtcggccctaccgagtcccaacggaacgggtaaccaacggtagtaccgtacgtacgaaccacgttaacggaggtcggacgtacgaggaacgaacggaggaccggtacgagttacgaaccttacgcctagttaacgaataaagtccgaacgaagtaacgacgaacaacgggtacgaacggacggtaggtacgttcggtaggggtccgttacgggacgggtaccggtacgacggtaccctacggtacccggttacaaccggtaccgccgtaccggtaaccccgg

SEQ ID NO: 103034 - DNA, 701 bp, Homo sapiens
  misc_feature: GYAE6OF01CU7WR.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctctcactctctgcacaggctcgtgacggcctacctatgacgctgacacgagcccaccgtggtgtacacgtcgtcccgaaggacacggacggccaggactaccaccgttgcgttacgtaggagtatcggctagttacggaactaaacgcgtattacgacgttcctttaccgtagggtaacccaggactaaggaacgccgaggacccaccgggtccctggtgggtcggtataagtaataacgaacgaccgttaggaacggtaccgaccgtacggaagggttaccctaccgtaggagtaaccgacttcgtacgtcggacctcgacgtcgacggtaaggacaagtacgtactacgacactagtacgacggtagacgtacgaggtacaaacggtaaggacggtcgactacggtacgtactacgtacgtactaataacggaacgacgaactaacggataacgaacggtaccgtaacgtggtaaaccggtgttaccggggttaggtacggtacggggtaacggacgggtaaccgacggtacgaaccggttcccggtaaacgttacgacccgtaacggacccgtaaccgg

SEQ ID NO: 103035 - DNA, 840 bp, Homo sapiens
  misc_feature: GYAE6OF01B1XC6.3.34.D01.1.454.CMB.1.raw
  modified_base (392)..(392): a, c, t, g, unknown or other
  misc_feature (392)..(392): n is a, c, g, or t
  modified_base (675)..(675): a, c, t, g, unknown or other
  misc_feature (675)..(675): n is a, c, g, or t
tcagagacgcactccacgaccggtgctcgatttagatcgtctgtgttgggtttgggggtgggtccaggaggcagaactctgggtgtctcaccatggcctggactccctctacttccctcccccgtcctcacctcgtctgcacgaggtctacgtggacgtcccttacctagtgacgtctacgacaccgaccgccctacccgttggtcgtcgtacggtccgtacccgaaggaccaggcccggacaggtactccgacgtcgtctcgtaggaagtcgtacgtcgtaggttacgaacaaacgttctaattacgtacgttaccgttacggtaccgtacgagaccgaacgtaccgaccggtaccgacccgtaccggtccggttaggtcggtcggttaanaagttaacgtaaacggttaaacggccggtaaggacgggtaccctaccggtcggaaaccgttccggtaccggagtaaccggtacgttaaccttccggtacgtccggtacctacggtacccggtacgaaccggaacggtaaccgacccgttaggtaccggttaaaccttcggtaaccgtgttaccggaggttaccgtaacggtccgaagggtaacgtaacgggaacggtaccggacgtaacgttactaacctaccggtacgtaaggtttaaccaaacggttaacnccgggtaacgtacgaaccgtaggtaaaccgttaaccggaccgtacggtacgggtacgttcgggtacgggttgggtaaacccgggtcgggtaaccgggtacgtaacccggtagtaacccgttacggtaccctagtaacccgggccgtccggtacccggtccccggg

SEQ ID NO: 103036 - DNA, 713 bp, Homo sapiens
  misc_feature: GYAE6OF01DH7ZA.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctctatgagctgacacacgccaccctcggtgtcagtcgtcccaggacagacggccaggactcactgctctggagatgcattggacaagctatatgtacttacgacggtaccagacgaagaacgaccgacggaccgaccggtcccccgtggtgggttggtagtaatacgttaaagtaaaacggaccggtacggaacggaccggccccgtacggaacggggtacctacccgtagggacgtacgtaacttcgtccgtacggcctaccaggtacctacggaacgggtaccaaacgtcgtacctaggtacgacctagtacgacggttaggaccggtaccgaggacgaaggtaacggacggacgtcgtacgtaacctagttacctaacgtaggtaaacaaagttaaccggactaaacggagaaacgtaacgaaacggttaaccggaacccgtaacgggttacggtacggttacgggtgggttacgggggtaccgggaggggtaaacgggtacccgtaagccggttaaccgtacccggtaactaggtaaccgaccggtcccgtaacccggg

SEQ ID NO: 103037 - DNA, 733 bp, Homo sapiens
  misc_feature: GYAE6OF01AXV2I.3.34.D01.1.454.CMB.1.raw
  modified_base (228)..(228): a, c, t, g, unknown or other
  misc_feature (228)..(228): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggactcacctgctcgtggagntgctagttggacaaggtcttatatcgtactttacgtcggtaaccagtacaaggaacgccgtacggacccgaccggtcccccgttaggttcgggtcgggttagtaagttaacttaaaacgttaaaacggtacccggtaggaacggacggccccgttacggacgggtaccttcccgtaggtacgacggtaaactcgtccgttagggccctaccgacgccgttacggaacgggtaacaaaccgtcgttaccgtaacggttacgaacctattaccggaggtcgggacgtaccgagggaacctaaggaacggacggacggtacgtacggtaacttacgtaccgtacgttaacgtaacgtaagtacgacggaacgaacgtaacgtaacaaacggttaacgaacccgtagggttaggtacgttgggtcgggttacggtcggggtacgggaacggtaccgaaggtcccggtaacgtacccggtcgtaaccgcggaccgacccggtaacccggg

SEQ ID NO: 103038 - DNA, 716 bp, Homo sapiens
  misc_feature: GYAE6OF01D7GJ3.3.34.D01.1.454.CMB.1.raw
  modified_base (87)..(87): a, c, t, g, unknown or other
  misc_feature (87)..(87): n is a, c, g, or t
  modified_base (163)..(163): a, c, t, g, unknown or other
  misc_feature (163)..(163): n is a, c, g, or t
  modified_base (197)..(197): a, c, t, g, unknown or other
  misc_feature (197)..(197): n is a, c, g, or t
  modified_base (465)..(465): a, c, t, g, unknown or other
  misc_feature (465)..(465): n is a, c, g, or t
  modified_base (613)..(613): a, c, t, g, unknown or other
  misc_feature (613)..(613): n is a, c, g, or t
  modified_base (686)..(686): a, c, t, g, unknown or other
  misc_feature (686)..(686): n is a, c, g, or t
tcagagacgcactccacgaccggtgctcgatttagatcgtctgtggttggggtttgggggtgggtccaggaggcagaactctgggtntctcacatggcctggactccctctacttcctcccctctcactctctgacacgaggcttgaggacgtccctcttagngacgtctacgaaccacaccgccctcccgtggtcnctacggtccgacccgaggaaccgtcggaccggtaccgaaggtcctaccctactcggtacttcggaggaatacgtcgtagttagtaacgggaacctaaggtatttaacgtgtacccggttacttaacggtaacggtacgaacgaacgaacggaccgaccggtaccggtaccggccggtccgtgggttcgggtaggtactaataaacgtaacgtaacgtcgtaggaacggtaccgacgacggtacgtacgaccgtagaccgtgtaaccgngtacggtctcccgacaccgtacggtaacgaccgaaactaccgtgtaccgtacaccgtactaggtgtacgaggctaaccggaagtacggaacggtacgaaggtacgtcgttaaacacgtactacgtacaggttaacaggaacgtaacanacggtactaagcgtacgtaaggcgttaggccgttaagggttaccgcggtacgggaggtaccacgtggtaaccngtaccgtacggtacacgtccgagtacccgg

SEQ ID NO: 103039 - DNA, 858 bp, Homo sapiens
  misc_feature: GYAE6OF01D0BJ6.3.34.D01.1.454.CMB.1.raw
  modified_base (224)..(224): a, c, t, g, unknown or other
  misc_feature (224)..(224): n is a, c, g, or t
tcagagacgcactccacgaccggtgctcgatttagatcgtctgtgttgggttgggggtgggtccaggaggcagaactctgggtgtctcaccatcggcctggactcctctacttcctcccctcctcactctctgcacaggctcgtgacgccttctatgagtctgacacacgcccaccgttggtgtcgacgtccgtacccgaaggacgacggaccgccgtaggacnccgaccgtgcctcgtaggagtatcgtacagttcgaactacgtctatacgtacgttacttacgacggtaacgacgaccgaaggaccgaccgacgacccgtacggtcccgttggtgggttacggtagtaacttactaaaacggtaacggacggtacgacggaccgtacccgtacggaacgggtccttacccgggtgtaacggtaccgtaacgttccgttcgggtaccggtaccgttaccgtacggtaaccgtaacggtaaaccggaaaccttaaccgggtacgttaaccccggttaaacgttaccggtaaccgttagtaaccgggttccgggtaacggtacgggtaaccccgggtaaagggaaaccgtaaacgggtaaacggttaccccggggtaagtaccggtttaaccgtaacctttaacggtacccgttaatttaaccgggtaaactaaccggttaacgacgtaaaccgaaccggttaacgtaaccggtaaacggttaaccccggtaacggtacggttaacgggtccgggtttaaaggggtccggggtttacgggtaaccggggaacggtaaccggtaacgtacggtccgtaacccggttacgtaacgaccgtaccggacctccggtaacccg

SEQ ID NO: 103040 - DNA, 1039 bp, Homo sapiens
  misc_feature: GYAE6OF01A77N8.3.34.D01.1.454.CMB.1.raw
  modified_base (115)..(115): a, c, t, g, unknown or other
  misc_feature (115)..(115): n is a, c, g, or t
  modified_base (187)..(187): a, c, t, g, unknown or other
  misc_feature (187)..(187): n is a, c, g, or t
tcagagacgcactccacgaccggtgctcgatttagatcgtctgtgttgggtttgggggtgggtccaggaggcaaaactctgggtgtctcaccatggcctggatccctctacttcnccccctcctcactctctgcacaggctcgtagacggcctcctatgagctagacacacgccctacccgtcggtntacgaggtccgtccccgaaggaccgacgggaccggacccgaacgggtactacccgtaaccgttggtacccttccggttagggaagtaacgttcggtaacctaaggtttaccggaaacgtaaaacggttaccttaaagtttacgtacggttaaccgtttaccggttaccggtaaacccgtaaggaacgtaaaccggaacggccccggaacggtacccggacccggttccccggttgggtacggggtcgttaagaaacgttaacgtaaacgtaaaaccgggaccggtaagggaacgggtaccgtcccgtaacgggtaacggccccgtttaccggaaggtaccggtacttaaccggttcccgttccggtaaccggttcccctaaccggtaccgttaaccgggtaaaccggtaaaccgggaacgtttaaaaccggccggtttaaaccccgttaagggtacccgtaaacccgtggttaaccgttaggggtaaccgggaacccgttacggggaacgtaaacggaaaacgggtaaccggtaaggaccggttaccgtttaaacgaacccggttttaacacccggtttaaagtaaacgggttaaacccttaaaggacggtaaacccgaaacgggtttaaacccgaaaccggtaaacggtttaacccggggtaaacccgtaaacccgggtttaacggttcgggggtaacggttttaccggggtaacccggggttaacggggttacccggggaaacccggggtaccggaaacccgtacggtttaacccgggtacccggttaaccccgtaacggtaaacggttacccgaccccggttaaacccgggtcccgggttaacccccgg

SEQ ID NO: 103041 - DNA, 822 bp, Homo sapiens
  misc_feature: GYAE6OF01CREBQ.3.34.D01.1.454.CMB.1.raw
  modified_base (134)..(134): a, c, t, g, unknown or other
  misc_feature (134)..(134): n is a, c, g, or t
  modified_base (259)..(259): a, c, t, g, unknown or other
  misc_feature (259)..(259): n is a, c, g, or t
tcagagacgcactccacgaccggtgctcgatttagatcgtctgtggttgggtttgggggtgggtcaggaggcagaactcgtgggtgtctcaccgatggtccgtggactccctctacttcctcccctctcactcntacgcacgagctcgtggacgtacctctagtacgagtcagaacacacgtaccctaccgtggtcgtcgtacgtccgacccgaggacgacgggaccgacgtaagctaccgactgctcgagacgatagngtacgtaacgaataactacttagtacgtacggtaccttacggaacggacgtacgaacgtaagaaccggtcgaaccgtacgcccggttacgtgggtcggtacgtaagtaataaggttaaacaacggtcggaagaccgtaccggtacgacggttaccgacctacggagaacgttagaccttacggtctacggaactcggaactaccggaagaacggaaactttaccgaggtaaccctttaacgggaaccctttaacgaggtaaccgtaagggttaccgtaacgaaaccgggaaggaaggttaaaccggggaaacgtaacggggtaactaccgtaacgggtaacctagtaacccgtaaagttaacggtaaaagaacgttaaccggaacaaacggaaaccgttaaacggaaccaaacgggttaaacccgaacgggtaggtaccggttaggggttaaccggtaggggttaacccggggtacggggaaaccgggttcaacccgtaagggttacccttaacgggaacccgtttaggaaaccccgacgggtaaacctccggtaaccccggg

SEQ ID NO: 103042 - DNA, 779 bp, Homo sapiens
  misc_feature: GYAE6OF01DB6S4.3.34.D01.1.454.CMB.1.raw
tcagagacgcactccacgaccggtgctcgatttagatcgtctgtgttgggttgggggtgggtccaggaggcagaactctgggtgtctcaccatggcctggatccctctacttcctccccctcctcactctctcgcacaggctccgtgaacggccctcctatggacgcgtacgaccacgacgtccctaacccgttggtcgtacgacgtccggtacccgaaggaccaacggaccgggaccgaagggtactaccgtacctcgcgtacgtagggactagtcgaccgtaggttacggtaaactaaaaggtcttaattacgttacgttacgttacggtacgacgacgacgaacgaaccgaccgacggaccgtaccgtccggttaggtggtacgtagtaacgtaagtaacgtaacggtaacggtacggacggtaccggtaccgtacggtacggtccgtacgtacgacgtacgtcgtcgtcgtcgtactacgcgtacgacggaacgacgtaacgtacgtacgtacgtacgtactacgtacgtacggtacggtaacgcgggtaacggaagaacggtaacggacggtacggtacgtacgtaactacgtaacgtacgtaacgtaagacgtaacgaacgtacgacgtactaaaccgtaacggtaaacgtacggtaacgggtagttcggttacgggtcgggttaccggacggggtaacggaacgggtacggacccggtacgttacccggtaccggttaaaccggtataacccggtccgtaaccggtacccgg

SEQ ID NO: 103043 - DNA, 797 bp, Homo sapiens
  misc_feature: GYAE6OF01BX5WS.3.34.D01.1.454.CMB.1.raw
  modified_base (235)..(235): a, c, t, g, unknown or other
  misc_feature (235)..(235): n is a, c, g, or t
  modified_base (673)..(673): a, c, t, g, unknown or other
  misc_feature (673)..(673): n is a, c, g, or t
  modified_base (687)..(687): a, c, t, g, unknown or other
  misc_feature (687)..(687): n is a, c, g, or t
tcagagacgcactccacgaccggtgctcgatttagatcgtctgtgttgggtttgggggtgggtccaggaggcagaactcgtgggtgtctcaccatggcctggactccctctacttcctcccctcctcactctctacgcacaggctctagacggcctcctatgacgctagaacacgacgccctacccgtggtgcacgtcgacccgaggacacggaccgcaaggtctaccgaccgtnccgtgaaggagtatgacctagttcgaacaaacgtacagttagtcgtaccttaacgttacggaccgaacgacgaaacggaacggtcccgtaaacggaccggtccggtaccccgtaagggttcggttacgggtaacgtaagttaaacgtaaaacggtaaaaccgtaccggttaaggaaacccgggttaccggtaacccggtaaccggaacgggttaccgttaaaccggttaccggaaggtaaccgttaaaccgtaccggtttacggcggttaaaccctccgttacgaccggttaacgaaccgtaaaccggaacttaggaccctaagggttaccaaccgtagttaccggagtaccgggtacgtaccgaaggttacgaaacgggtaacccgagttaacgggacctaagtacttaacgaccttcgttaaacacgtttaaacgngtaacacggtaaanaccgttaagaaccgttacgaaccgagttgggtaacgttggaacgttgggaaccgtaacggtacggacgagtcccggtaaacacccggttcgaaggccctaggacccgtag

SEQ ID NO: 103044 - DNA, 492 bp, Homo sapiens
  misc_feature: GYAE6OF02HESCZ.3.34.D01.1.454.CMB.1.raw
  modified_base (313)..(313): a, c, t, g, unknown or other
  misc_feature (313)..(313): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctnagggatccctgagtgaatctctggctccagctcagggacaacagtcacgttgaccatcagtggagtccaggcagaagacgaggctgactatcactgtcaaatagacagacagcaatggaacccatagggctgtggtgttcggcggagggaccaagctgaccgtctaagtcagccaacgg

SEQ ID NO: 103045 - DNA, 309 bp, Homo sapiens
  misc_feature: GYAE6OF02IETQU.3.34.D01.1.454.CMB.1.raw
  modified_base (304)..(309): a, c, t, g, unknown or other
  misc_feature (304)..(309): n is a, c, g, or t
tcagagacgcactccacgaccggtgctcgatttagatcgtctgtgttgggtttgggtgaggtctgtgtcactgtggtattactatggttcgggagttaaagcagatgtttactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnnn

SEQ ID NO: 103046 - DNA, 310 bp, Homo sapiens
  misc_feature: GYAE6OF02IE77K.3.34.D01.1.454.CMB.1.raw
  modified_base (307)..(310): a, c, t, g, unknown or other
  misc_feature (307)..(310): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 103047 - DNA, 312 bp, Homo sapiens
  misc_feature: GYAE6OF02IY372.3.34.D01.1.454.CMB.1.raw
  modified_base (307)..(312): a, c, t, g, unknown or other
  misc_feature (307)..(312): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnn

SEQ ID NO: 103048 - DNA, 496 bp, Homo sapiens
  misc_feature: GYAE6OF02JBB82.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctcagggatccctgagcgaatctctggctcagctcagggacaacagtcacgttgaccatcagtggagtccaggcagaagacgaggctgactatcactgtcaaatagcagacaggacaatggaacccagtaggctgtggtgttcggcggagggaccaagcgtgaccgtccgaagtcagcccaacgg

SEQ ID NO: 103049 - DNA, 545 bp, Homo sapiens
  misc_feature: GYAE6OF02FW9IE.3.34.D01.1.454.CMB.1.raw
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagagacgcactccacgaccggtgctcgatttagatcgtctgtgggttgggtttgggggtgggtcccaggaggcgagaacctctgggttgtctcaccatggcctgggatccctctacttctcccctcctcactctctgtcacaggctctgaggtcctcctatgagcttagacacagccaccctcggtgtcagtgtccccagggacagacgggccaggtatcaacctggctcctggagatgcattggcaaagcctatatcgtcttacnggtaccagcagaagccaggccagggccccctggtggtagggtgagtagtagttaaaaggacccggttagaagacggaccccttnagggaatcccgtagagcgaatctctggctccagctacagggacaaacngtcaacgtttgaccagtcagtgagtaccagcagaagacgagctgactancactgcaaanagcagacagcaatggaacccatacggcttgagtgttcggacggacgggacctaaggcgtagaccgtccgtaagtcagccctaacgg

SEQ ID NO: 103050 - DNA, 312 bp, Homo sapiens; identical to SEQ ID NO: 103047
  misc_feature: GYAE6OF02ILRRF.3.34.D01.1.454.CMB.1.raw
  modified_base (307)..(312): a, c, t, g, unknown or other
  misc_feature (307)..(312): n is a, c, g, or t

SEQ ID NO: 103051 - DNA, 514 bp, Homo sapiens
  misc_feature: GYAE6OF02IRIAG.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaaagctatatgcttactggtaccagcagaagccaggccaggcccctgtggtggtgatatataaagaccgtgagaggccctcgagggactccctgagcgaatctctggctccagctcagggacaacagtcacgttgaccatcagtggagtccaggcagaagacgaggctgactatcactgtacaaatagacagacagacaagtcggaaacccaagtacgggctggtgggtggttcgggacgggagggaaccagcgtacgaccgtctaagcacggcccaacgg

SEQ ID NO: 103052 - DNA, 523 bp, Homo sapiens
  misc_feature: GYAE6OF02G2F55.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtacaaatagacagacagacaagtggaacccagtagggctaggtggtggttcgggacgggacgggaccgaaggccgtaggacccggttaccgtaaggtccacggcccgtaacggg

SEQ ID NO: 103053 - DNA, 497 bp, Homo sapiens
  misc_feature: GYAE6OF02G923C.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtacaaatagacagacagacaatcggaaaccagtagggctgtggtgttcggcggagggaccaagctgaccgtctaagtcagccaacgg

SEQ ID NO: 103054 - DNA, 501 bp, Homo sapiens
  misc_feature: GYAE6OF02G30C0.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctcagggatccctgagcgaatctctggctccagctcagggacaacagtcacgttgaccatcagtggagtccaggcagaagcgaggctgactatcactgtacaaatagcagacagcaagtgaacccatagggctgtggtgttcggcgggagggaccaaggctaggaccgtccgtaaggtcagccctaacgg

SEQ ID NO: 103055 - DNA, 506 bp, Homo sapiens
  misc_feature: GYAE6OF02GHCK6.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctcagggatccctgagcgaatctctggctccagctcagggacaacagtcacgttgaccatcagtggagtccaggcagaagacgaggctgactatcactgtcaaatagcagacagcaatcggaaccagtagggctgtggtggttcggcgggaagggaccaagcgtaggaccgtaccgtaagtcgacgcccaacggg

SEQ ID NO: 103056 - DNA, 611 bp, Homo sapiens
  misc_feature: GYAE6OF02IU9M4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgggcaaagctatatgcttactggtaccagcagaagccaggccacggcccctgtggtggtgatatagtaaaggaccgtgagaggccctacgagggactccctaggacgacgaaactcctctgggcctccgaagctacgaacggggaccaaacgacgtacgtacggtttacgaacccagtactaaggtagggacgttacccgaaggccaaggaaaggaacggagggactaggactaactcaacgtgtaacaaatagacgagtacaggacgaaactacgggaaacccagtacgggacttggttcggtacggttcgggaccggaacggggacccaaggtcgtacggacccggttacccgtaagtacccgacggaccccgtaacggg

SEQ ID NO: 103057 - DNA, 509 bp, Homo sapiens
  misc_feature: GYAE6OF02GZLI8.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaaggaccgtgagaggccctcgagggatccctgagcgaatctctggctccagctcgagggacaacagtcacgttgaccatcagtggagtccgaggcagaagacgaggctagactatcactgtacaaatagacagacagacaagtcggaacccagtacgggctggtggtggttcgggcggtagggaccagctagaccgtctaagtcacgcccaacgg

SEQ ID NO: 103058 - DNA, 541 bp, Homo sapiens
  misc_feature: GYAE6OF02GERVI.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcgagggacaacagtcacgttgaccatcaggtgagtccaggcagaagacgaggctgactatcactgtacaaagtgacagacagacaacgttacggaaacccagtacggggcttgggtcggttggttcggggaccggaaggggaacccaaggcgttacggaacccggttaccgtaacggtacgacggaccctaacggg

SEQ ID NO: 103059 - DNA, 561 bp, Homo sapiens
  misc_feature: GYAE6OF02HCBHQ.3.34.D01.1.454.CMB.1.raw
tcagagacgcactccacgaccggtgctcgatttagatcgtctgtgttgggtttgggggtgggtccagggaggcagaactctgggtgtctcaccatggcctggatccctctacttcctccccctcctcactctctgcacaggctctgaggcctcctatgagctgacacagcccacccgtcggtgtcagtcgtccccaggacagacggccaggatcacctgctctggagatgcattggacaaagctatatgcttactggtaccagcaagaagccaggccacggcccctggtggtggtgatatataaagaccgtagagacggccctcgagggactcccgtgacgcgaatctcgtggcctacgagctcgagggacaacgagtacacgttcgaccatcgagtggacgtccgaggcaaggaaggacgaggctagactatcaactgtaacaaatacgacagacagacaagtacggaaccagtacggctgggtggtggttcgggacgggaagggaaccgaacggtcgtacggacccggttaccgtaacggtccgaccgacccgtaacgg

SEQ ID NO: 103060 - DNA, 580 bp, Homo sapiens
  misc_feature: GYAE6OF02HINKB.3.34.D01.1.454.CMB.1.raw
  modified_base (223)..(223): a, c, t, g, unknown or other
  misc_feature (223)..(223): n is a, c, g, or t
  modified_base (382)..(382): a, c, t, g, unknown or other
  misc_feature (382)..(382): n is a, c, g, or t
tcagagacgcactccacgaccggtgctcgatttagatcgtctgtgttgggtttgggggtggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattggacaaagctatatgcttactggtaccagcagaagccaggccaggcccctgtggtggtgatataataaagaccgtgagacggccctcgagggatccctgacgcggatcgctaggctcagacgtcaggacacagtcgacgtgacgactacagnggtagcgacggagacgaagaacggtaggacgttacggactagtactactgtaccgtaagtaagacgacgaacgagacgtaagtaacgggtaaccgaacggtacggtacgtgttacgggttacggtttcgggacgggtacgggaaccgaacggccgtacgtaccggtaccgtaacggtaccgtacggaccgtaacccgg

SEQ ID NO: 103061 - DNA, 500 bp, Homo sapiens
  misc_feature: GYAE6OF02IP32U.3.34.D01.1.454.CMB.1.raw
  modified_base (404)..(404): a, c, t, g, unknown or other
  misc_feature (404)..(404): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactancactgtacaaatagacagacagcaaatggaacccagtagggctgtggtggttcggcggagggaccaagctaggaccgtcgtaagtcagcccaacgg

SEQ ID NO: 103062 - DNA, 543 bp, Homo sapiens
  misc_feature: GYAE6OF02HB2ST.3.34.D01.1.454.CMB.1.raw
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcttgagatgcattggcaaagctatatgcttactggtaccagcagaagccaggccaggcccctgtggtggtgataatataaagaccgtgagaggccctcgagggactcccgtgagcgaatctcgtggcctccagctcgagggacaanagtcacgtttcgaccatcagtggacgtccgaggcaaggaagacgaggctagactanctactgtacaaatacgacagacagacaagtacggaaacccagtacgggntggtggttcggttcgggacgggaacgggaccaaggcgtacggacccggttaccgtaaggtccacggaccctaacgg

SEQ ID NO: 103063 - DNA, 528 bp, Homo sapiens
  misc_feature: GYAE6OF02I2QFQ.3.34.D01.1.454.CMB.1.raw
  modified_base (313)..(313): a, c, t, g, unknown or other
  misc_feature (313)..(313): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctnagggatcccgtgagcgaatctctggctccagctcagggacaacgagtcacgttgaccatcagtggagtccaggcaagaagacgaggctgactatccactgtacaaaatagcaggacaggacaagtggaaacccagtagggctggtggtcggttcgggcgggaaggggaccaaggcgtacggtacccggtacctaacggtccaggtccccaacggg

SEQ ID NO: 103064 - DNA, 542 bp, Homo sapiens
  misc_feature: GYAE6OF02GDD0I.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcgagtggagtccaggcaagaagacgaggctgactatcactgtacaaatagacagacagacaaagtcggaaacccagtaacgggtctaggtgggttggttccgggacggggtaacgggtaaccgaaggcgtacggtacccggttaccgtaaggtccacggacccgtaaccggg

SEQ ID NO: 103065 - DNA, 533 bp, Homo sapiens
  misc_feature: GYAE6OF02GR6VB.3.34.D01.1.454.CMB.1.raw
  modified_base (415)..(415): a, c, t, g, unknown or other
  misc_feature (415)..(415): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtgagaggccctcgagggatcccgtgagcgaatctctggctccagctcgagggaccaacagtacacgttgaccatcagtggagtccgaggcagaagacgagctagactatcatntacaaatgacagacagacaagtacggaaacccagtacggctggtggttggtcgggacgggacgggaaccgaaggttttcgacggtaccgtaccgtaaggtccacggacccgtaacggg

SEQ ID NO: 103066 - DNA, 534 bp, Homo sapiens
  misc_feature: GYAE6OF02IXOP0.3.34.D01.1.454.CMB.1.raw
  modified_base (400)..(400): a, c, t, g, unknown or other
  misc_feature (400)..(400): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaaggccaggcccctgtggtggtgatatataaagaccgtgagaggccctcagggatccctgagcgaatctctggctaccaggctcgagggacaacagtcacgtttgaccatcagtggagtccagcagagacgagcngactagtacactgtcaaatcgacagaccaagacaaagtacggaacccaagtacgggactcggtggtaggttcgggacgggtacgggaaccgaaagcgtacggaccgtacctaaggtccgaccgaccgtaacggg

SEQ ID NO: 103067 - DNA, 518 bp, Homo sapiens
  misc_feature: GYAE6OF02GFYXD.3.34.D01.1.454.CMB.1.raw
  modified_base (404)..(404): a, c, t, g, unknown or other
  misc_feature (404)..(404): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtgagtccaggcagaagacgaggctagactancactgtacaaatagacaagacagacaaagtcggaaacccagtagggctggtggtggttcgggacggacgggaccaaggctacggaccgtccgtaaggtccacgacccgtaacgg

SEQ ID NO: 103068 - DNA, 514 bp, Homo sapiens
  misc_feature: GYAE6OF02JALXI.3.34.D01.1.454.CMB.1.raw
  modified_base (314)..(314): a, c, t, g, unknown or other
  misc_feature (314)..(314): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtcggtggtgatatataaagaccgtgagagccctnagggactccctgagcgaatctctggctcagctcgagggacaacagtcacgttgaccatcagtggagtccaggcagaagacgaggctgactatcactgacaaatgacgagacagcaagtacgaaccagaggctgtaggtcgtcgggacggaacgggaccgaagcgtacggaccgtaccgtagtaccacggaccctaacggg

SEQ ID NO: 103069 - DNA, 514 bp, Homo sapiens
  misc_feature: GYAE6OF02IF0BG.3.34.D01.1.454.CMB.1.raw
  modified_base (293)..(293): a, c, t, g, unknown or other
  misc_feature (293)..(293): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatanaaagaccgtgagaggccctcagggactcccgtgagcgaatctctggctccagctcgagggacaaacgagtcacgtttcgacctatcagtggagtccaggcaagaagacggagctgactatcactgacaaatagacagacagacaatcggaaaccagtagggctagtggttggtcgggacggaggaccgaagctcgaccgtacctaagtcaccgtaccacgg

SEQ ID NO: 103070 - DNA, 589 bp, Homo sapiens
  misc_feature: GYAE6OF02IZPI9.3.34.D01.1.454.CMB.1.raw
  modified_base (429)..(429): a, c, t, g, unknown or other
  misc_feature (429)..(429): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctggagatgcattggacaaagctatatgcttactggtaccagcagaagccaggccaggcccctgtgtgtgatatataaagaccgtagagacggcctcgagggactcccgtggacgcgaaatctacgtggccttaccgagctcgagggacaacgagtcacgttgaccaatcgagtggacgtccaggcaagaacgacggaggctagactacncacgtagtaccaaagtcgacgagtaactaagaccgtaaagtacggaaccctaaagtacgggacttaggtacggttacgggttccgggacggggtaacggggaacccgaaggtccgacggttaccccgtaacgttaacggcctacggaccccgtaaacggg

SEQ ID NO: 103071 - DNA, 516 bp, Homo sapiens
  misc_feature: GYAE6OF02JH0GT.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacgagtcacgttgaccatcagtggagtccaggcagaagacgaggctgactatcactgtacaaatagcagacagacaaatcggaaacccagtacgggctgtggtggttcgggacggaagggacccaagcgtacggaccggtacctaaggtcgacgcccgaacgg

SEQ ID NO: 103072 - DNA, 775 bp, Homo sapiens
  misc_feature: GYAE6OF02G77TD.3.34.D01.1.454.CMB.1.raw
tcagagacgcactccacgaccggtgctcgatttagatcgtctgtgttgggtttgggggtgggtaccgagggaggcagaactctgggtgtctcaccatggcctggatccctctacttctcccctcctccactctctgcacaggctctgaggcctcctatgagctgacacagccaccctcggtgtcagtgtccccaggaccagaccgccaggactcacctgctctggagatgcattggacaaagctaatactgcttacgtggttaccaggtccagaacgccgaaggccaggcccctaggtcggttggtgatataagtaaagaccgtagagacggccctcgacgggactcccgtgacgcgtaagtctacgtggtcctccgagccgtacgacggggaaccaacgacggtaccgtaaccggtttacgaacccgtagttaccgaagggttacgggaacgttacccggaacggggtaccgaaacgggaaaacgggaaccgggaacggggtacccgttaagggtaaacccttaacgttacccgtaacgttacggtaaaccgtaaacgtaacggtaaccgaaacggaaccgaaggaaccgtaaacggttaaccgggtaaaaccccgttaagggttaaccggggtaccgttacgggttacgggttacgggtttaccggggacccggggtaaccggggtaaacccggaacgggttacccgttaaccgggtaaccccggtttacccgttaaacggtccccggtaacggtaccccggtaaacccgggg

SEQ ID NO: 103073 - DNA, 575 bp, Homo sapiens
  misc_feature: GYAE6OF02HIVKH.3.34.D01.1.454.CMB.1.raw
  modified_base (314)..(314): a, c, t, g, unknown or other
  misc_feature (314)..(314): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctnagggatccctgagcgaatctctggctccgagctcgagggaccaaacgacggtccaacggtttcgaacctagtaccgaaggttgggaacgtacccgagggaccaagggaaacggaccgagggccttaggacttactcaactgtaccaaaagtagacaagacgagacaagtccggaaacccagtagggcctggtggttcggttcgggacggtaagggaccaagtccgtagacccgtacgtaacggtacacggtacccaacggg

SEQ ID NO: 103074 - DNA, 545 bp, Homo sapiens
  misc_feature: GYAE6OF02JCS5B.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggccccctgtcggtggtgatatataaagaccgtgagaggccctcagggatccctgagcgaatctctggctccagctcagggacaacagtcacgttgaccatcagtggagtccgggcagaagacgaggctgactatcactgtacaaatagacagacagacaagtacggaacccagtacgggcttggtacggttggttacgggcgggtaacgggaccgaaggcgtacgggacccgttaccgtaaggtacccgacggtaccccgaacgggtacccg

SEQ ID NO: 103075 - DNA, 324 bp, Homo sapiens
  misc_feature: GYAE6OF02G5BIY.3.34.D01.1.454.CMB.1.raw
  modified_base (307)..(324): a, c, t, g, unknown or other
  misc_feature (307)..(324): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcgacctctgggggcacagcggccctgggctgcctggtcaaggactacttccgagtgcgtctctgagcgggctggcaagcgcatagnnnnnnnnnnnnnnnnnn

SEQ ID NO: 103076 - DNA, 553 bp, Homo sapiens
  misc_feature: GYAE6OF02HBZE5.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtacaaatagacagacagacaagtacggaacccagtagggcttgggtggttcggtttcggggacgggtaacgggggaacccgaaggtccgttacgggtacccggttacccgttaaacggtcccgtaacggacccccgtaaacggg

SEQ ID NO: 103077 - DNA, 525 bp, Homo sapiens
  misc_feature: GYAE6OF02G6GP8.3.34.D01.1.454.CMB.1.raw
  modified_base (359)..(359): a, c, t, g, unknown or other
  misc_feature (359)..(359): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtcggtggtgatatataaagaccgtgagaggccctcgagggatcccgtgagcgaatctctggctccagctcagggacaacngtcacgttgaccatcagtggagtccaggcagaagacgaggctgactatcactgtacaaatagacagacagacaagtcggaaacccagtacgggctggtggtcggttcgggacggacgggaccaaggccgtacggacccggtcctaaggccacggacccgtaacggg

SEQ ID NO: 103078 - DNA, 621 bp, Homo sapiens
  misc_feature: GYAE6OF02G7Q3U.3.34.D01.1.454.CMB.1.raw
  modified_base (374)..(374): a, c, t, g, unknown or other
  misc_feature (374)..(374): n is a, c, g, or t
tcagagacgcactccacgaccggtgctcgatttagatcgtctgtgttgggtttgggggtggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattggcaaagctatatgcttactggtaccagcaagaagccaggccaggcccctgtcggtggtgatatataaagaccgtgagaggccctcgagggatcccctgagcggaatcgctaggctcagcgtcagacacagtacgacgtgacacncagtggagtacaggcagaagaacggaggatacgactagtacactacgtacgaactaagaccgagtaacgaacgtaccgtaaagtaacgggtaaacccgaacggtaacgggtacggttaccggtagggtttacggggttccggggttaaccggggacgggggtaaacccgaacggtacccggttaacggttaccccgggttacccgttaaacgggttacccgttaccggaaccccgtaaaccccgggg

SEQ ID NO: 103079 - DNA, 618 bp, Homo sapiens
  misc_feature: GYAE6OF02JXG9K.3.34.D01.1.454.CMB.1.raw
  modified_base (227)..(227): a, c, t, g, unknown or other
  misc_feature (227)..(227): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagagacgcactccacgaccggtgctcgatttagatcgtctgtgttgggtttgggggttgggtccgaggaggcgagaactctgggtgtctcaccatggcctggatcctctacttctcccctcctcactctctgcacaggctctgacggcctcctatgagctgacacagccaccctcggtgtcagtggtccccaggaccagaccggccaggatcacctgctctgganatgcattggcaaaagctatatcgcttactggtaccagcaagaacgccaaggccaggccccgtgtcgggtcggttggatataagtaaagccggtaggacggacggcccgttcgaggggtacacccgtgtacgcgaaactctactcgggctccgacgctcgagggacaacacggtcaacggtttcgaaccacgtacgacggtggtacgtaccgaggctaagaacggacgagacgttagacgtatacacgtagtaccaaagtacacgaagaccgtaagactaaacgnggtaaacccgagtaaccgggnttacgggtggttacggttcgggacgggtacgggaacctaacggtcgtaacggtaccggtaccgttaggacgtacggccctaacggg

SEQ ID NO: 103080 - DNA, 511 bp, Homo sapiens
  misc_feature: GYAE6OF02IMTS4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccagaccaggcccctgtggtggtgatatataaagaccgtgagaggccctcagggatccctgagcgaatctctggctccagctcagggacaacagtcacgttgacatcagtgagtcaggcagaagacgaggctgactatcactgtacaaatagacagacagacaaatggaaacccagtacgggctaggtggttggttcgggacgggagggaccgtaaggctaggaccgtcctaagtcacgccctaacgg

SEQ ID NO: 103081 - DNA, 314 bp, Homo sapiens
  misc_feature: GYAE6OF02IHARG.3.34.D01.1.454.CMB.1.raw
  modified_base (306)..(314): a, c, t, g, unknown or other
  misc_feature (306)..(314): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaaggcccatcggtcttccccctggcaccctcctccaagagcacctctgggggcacagcggccctgggctgcctggtcaaggactacttccgagtgcgtctctgagcgggctggcaaggcgcatagnnnnnnnnn

SEQ ID NO: 103082 - DNA, 597 bp, Homo sapiens
  misc_feature: GYAE6OF02HEDX8.3.34.D01.1.454.CMB.1.raw
  modified_base (359)..(359): a, c, t, g, unknown or other
  misc_feature (359)..(359): n is a, c, g, or t
  modified_base (426)..(426): a, c, t, g, unknown or other
  misc_feature (426)..(426): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggcaaagctatatgcttactggtaccagcagaagacaggccaggcccctgtggtggtgatatataaagccgtgagaggccctgagggactccctgagcgaatctctggctccagctcgagggacaacgngtacacgtttgaccattcgagtggacgtccgagggacaaggaacgacggaacggtctagacgttaanccgaagttcgtacaaaatggacaaggaccaagaccaaatacggaaacccagttaacgggcgttaggtacgggttacggtttccggggacgggtaacgggaacccgaacgggtcgttaaccggaacccggttacccgtaaacgggtaccgtaaccggaccccgtaaccgggg

SEQ ID NO: 103083 - DNA, 533 bp, Homo sapiens
  misc_feature: GYAE6OF02HG8KC.3.34.D01.1.454.CMB.1.raw
  modified_base (313)..(313): a, c, t, g, unknown or other
  misc_feature (313)..(313): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctnagggatccctgagcgaatctctggctccagctcgagggacaacagtcacgtttgaccatcagtggatccaggcagaagacgaggctagactatcatgtacaaatgacagacagacaatacggaaacccagtacgggctaggtgggttcggttcgggacggacggggaccaaggtccgtacggtacccggttaccttaaggtccacggaccccgtaacggg

SEQ ID NO: 103084 - DNA, 527 bp, Homo sapiens
  misc_feature: GYAE6OF02H5120.3.34.D01.1.454.CMB.1.raw
  modified_base (312)..(312): a, c, t, g, unknown or other
  misc_feature (312)..(312): n is a, c, g, or t
  modified_base (356)..(356): a, c, t, g, unknown or other
  misc_feature (356)..(356): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattggcaaagctatatgcttactggtaccagcagaagccaggccaggcccctgtggtggtgatatataaagccgtgagaggccctnagggactccctgagcgaatctctggctccagctcagggacaacngtcacgttgacctatcagtggagtccaggcagaacgacgaggctgaactatcactgtaccaaatacgacagacagacaatacggaaacccagtacgggcttggttcgggtggttccgggacgggagggaacccaaggcgtacggaccgtcgtaacgcgacggccctaacgg

SEQ ID NO: 103085 - DNA, 545 bp, Homo sapiens
  misc_feature: GYAE6OF02G5CSF.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatcccctgagcgaatctctggctccagctcgagggacaacagtcacgttgaccatcagtggagtccaggcaggaagacgaggctgactatcactgtacaaatgacagacagacaagtcggaaacccagtacgggcttggtacgggttggttcgggacgggtaacggggaacccaaaggtccgtacggtacccggttacccgttaaggtccgacggaccccgtaacggg

SEQ ID NO: 103086 - DNA, 586 bp, Homo sapiens
  misc_feature: GYAE6OF02G8JLD.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcaagaagccaggccacggcccctggtggtggtgatataataaacgaccgtgaggacggccctcgagggactcccgtgacgcgaatcgtcgtggctccgagctacgagggaacaacgagtccacgttcgaaccagtacgaggtcgggacgtacccgaggacgaaggaacggaacggacggtcttacggaacttacaccgtactacgtacaaagtagacaagacgagacaaacgtacggaaacccagtacgggctagggttggtacggttcggggacgggaagggaccaaggcgtacggaccgtaccgtaagaccgacggacccgaacgg

SEQ ID NO: 103087 - DNA, 505 bp, Homo sapiens
  misc_feature: GYAE6OF02H7M4F.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactgtaccagcagagccaggccagccctgtggtggtgatatataaagaccgtgagaggcctgagggatcccgtgagcgaatctctggctccagctcgagggacaacagtcacgtttgaccatcgagtggagtcgaggcaagaagacgaggctgactatcactgacaaatacgacagacagacaaatcggaaaccagtacgggctggtggtggttcggcggagggacctaagctgaccgtccgtaagtcgacgccaacgg

SEQ ID NO: 103088 - DNA, 539 bp, Homo sapiens
  misc_feature: GYAE6OF02IECKK.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagacggccctcgagggactccccgtgagcgaatcctctggcctccagctacgagggacaacagtcacgtttgaccatcagtggagtccaggcagaagacgaggctgactatcactgtacaaatagacagaacagacgaagtacggaacccagtacgggcttggtggtggttcgggacgggacgggaccgaaggccgtcggaacccgttaccgtaacggtcacggacccgtaacggg

SEQ ID NO: 103089 - DNA, 589 bp, Homo sapiens
  misc_feature: GYAE6OF02JBFJB.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacctctccccctcctcactctctgcacaggctctgaggcctcctatgagctgacacagccaccctcggtgtcagtgtccccaggacagacggccaggatcacctgctctggagatgcattggacaagctatatgcttacgtcggtaccagcaagaacgccgacggccacggcccctggtcggtggtgatataagtaaacgaccgtaggagacggccctcgagggtactcccgtgacgacgtaactctcgtggctccacgtctcgaacgggaacaacgtacgtcgtacgttacgaccatacgaggtgggactccgaggcgaaggaacggacgaggctagtactagtcactgtaacaaatacgacgagacgagactaagtacggaaaccagtagggctggtggtcggttcgggacgggtacgggaaccgacggtcgtacggtacccggttaccgtaacggtaccgacggtacccggtaacgg

SEQ ID NO: 103090 - DNA, 513 bp, Homo sapiens
  misc_feature: GYAE6OF02HPZQD.3.34.D01.1.454.CMB.1.raw
  modified_base (435)..(435): a, c, t, g, unknown or other
  misc_feature (435)..(435): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatagtaaagaccgtgagaggccctcgagggatccctgagcgaatctctggctccagctcgagggacaacgagtcacgttgaccatcagtggagtcaggcagaagacgagctagactatcactgtacaaatagacagacagacaagnggaaacccagtagggctgtggtggttcggcggacgggacgaagcgtacggaccgtacgtaaggtcacgaccgtaacgg

SEQ ID NO: 103091 - DNA, 560 bp, Homo sapiens
  misc_feature: GYAE6OF02HLISU.3.34.D01.1.454.CMB.1.raw
  modified_base (360)..(360): a, c, t, g, unknown or other
  misc_feature (360)..(360): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtgagaggccctgagggactcccgtgagcgaatctctggctccagctcgagggacaacngtcacgttcgacatcgagtggatccgaggcaggaagacgaggctagactagtcactgtacaaatgacagacagacaagtacggaaaccctaagtacgggcttagggtcggttaggttccgggacgggtaacggggaaccgtaaggccgttacggaacccggttaccgttaaacgggtaccaccggtaccccgtaaccggg

SEQ ID NO: 103092 - DNA, 510 bp, Homo sapiens
  misc_feature: GYAE6OF02IQDBT.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagagccctcagggatccctgagcgaatctctgctccagctcagggacaacagtcaccgttgaccatcagtggatccgaggcagaagacgaggctgactagtcactgacaaatagacagaacagcaaacgtggaaacccagtacggcgtgtggtggttcggcggagggaccaagctacgaccgttccgtaagtccagacccgtaacgg

SEQ ID NO: 103093 - DNA, 567 bp, Homo sapiens
  misc_feature: GYAE6OF02JWMTV.3.34.D01.1.454.CMB.1.raw
  modified_base (415)..(415): a, c, t, g, unknown or other
  misc_feature (415)..(415): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattggcaaagctatatgcttactggtaccagcagaagccaggccacggccctgtggtggtgatatataaagccgtagagacgcctcgagggactccgtgagcgaatctcgtggctccagctcgagggacaacgagtcacgttacgaccatcagtggacgtcgaggcagaacgacgaggctagactancactgacaatagacagacagacaagtacggaaaccctaggtacgggacgttgggtacggttagggttaccggggacgggtaacgggtaaccgaaggtccggttaacgggtacccgttaaccgtaacggtaccgaccggtaccccggtaacgg

SEQ ID NO: 103094 - DNA, 508 bp, Homo sapiens
  misc_feature: GYAE6OF02G47IO.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagagccaggccaggcccctgtggtggtgatatataaagccgtgagaggccctgagggatccctgacgcgaatctctggctccgagctcgagggacaacagtcacgttgaccatcagtggacgtcaggcagaagacgaggctagactatcactgtacaatagcagacagacaagtcggaaccagtacggctgtcggtgttcggcgggaggaaccgagcgtacggaccgttctaacggtcacggcctaacgg

SEQ ID NO: 103095 - DNA, 597 bp, Homo sapiens
  misc_feature: GYAE6OF02H6BTL.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctggagatgcattggacaaagctatatgcttactggtaccagcagagccaggccaggcccctgtggtggtgatataataaagaccgtgagacggccctcgagggactccctgacgcgaatcctcgtggctccgagctacgacgggaacaacgacgtcaacgtttcgaacctatcgaggtcgggacgtccgaagggcaaggaacggacggaggctagaactaatccactgtacaaagtagacaagacagacaaagtaccggaaacctaggtacgggcttagggttacgggttcgggttcggggaccgggaaggggaacccgtaaggccgttaccggaacccggttaccgttaaggtaccgaccggtacccgtaaccggg

SEQ ID NO: 103096 - DNA, 516 bp, Homo sapiens
  misc_feature: GYAE6OF02GT5LQ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggactccctgagcgaatctctggctccagctcgagggacaacagtcacgttgaccatcagtggagtccaggcagaagacgaggctgactatcactgtacaaatagacagacagacaagtcggaaacccagtacgggctggtggtggttcgggacggagggaccaagcgtacggaccgttccgtaagtcacgccctaacgg

SEQ ID NO: 103097 - DNA, 584 bp, Homo sapiens
  misc_feature: GYAE6OF02JZ24S.3.34.D01.1.454.CMB.1.raw
  modified_base (221)..(221): a, c, t, g, unknown or other
  misc_feature (221)..(221): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattggacaaagctatatgcttacgtggtaccagcagaagccaggccgaggcccctgtggtggtgatatataaagaccgtgagaggccctacgagggactcccgtagacgaccgaagtctcgtggcctaccgagcctacgaagggtaaccaacgacggtacctacgtttacgaaccatcgaggtcggacgtccgaggacaggaacgacgaggctagactatacacgtagtacaaatcgacaggacagactaacgtacggaacccagtacgggtctaggaggttcggtacgggacggagggtaacccgaaggtacgtacggtaaccggtaccgtaacggtccgaccggtacccgtaacggg

SEQ ID NO: 103098 - DNA, 618 bp, Homo sapiens
  misc_feature: GYAE6OF02GHL8F.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtacagcagaagccaggccaggcccctgtggtggtgatataataaagaccgtgagaggccctgagggatccccgtgagacgaaatcctacgtcggctccgagtctacgaaggggaaccaaacgacgtacgtaaccgtttagaccctagtaccgaaggttcgggacgtaccagggcaaggaagacggaggctagactatcactgtacaaatagacagaccagacaaagtacggaaacccgagtaggggaccttagggttgggttacgggtttccggggaccgggtaaacgggggaaccccaagggtaccgttacggtaaccccggttaaccgttaaaccggttccgaaccggtaccccgaaaccgggg

SEQ ID NO: 103099 - DNA, 590 bp, Homo sapiens
  misc_feature: GYAE6OF02G2XK1.3.34.D01.1.454.CMB.1.raw
  modified_base (294)..(294): a, c, t, g, unknown or other
  misc_feature (294)..(294): n is a, c, g, or t
  modified_base (471)..(471): a, c, t, g, unknown or other
  misc_feature (471)..(471): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagcacggccaggcccctgtggtggtgatatanaaagaccgtgaggacgacctcgagggactccgtgacgacgaactctcgtggcctaccgacgcgtacgaagggtaaccaaacgacgtaccgtacgttacgacctatcgaggtcggacgtccgaggacaacggaacggacggaggtctagtaactagtctacgtagtaacgaatacganacgacacgacaagtacggaaacccaggtacgggacgttggttcgggtaggtcgggtagggaacggtaacgacggtccgtacggtacccgtacgaccggtaccgtaccgacccgtaacgg

SEQ ID NO: 103100 - DNA, 613 bp, Homo sapiens
  misc_feature: GYAE6OF02HTC4Q.3.34.D01.1.454.CMB.1.raw
tcagagacgcactccacgaccggtgctcgatttagatcgtctgtgttggggtttgggggtgggtccaggaggcagaactctgggtgtctcaccatggcctcggatccctctacttctccccctcctcactctctgcacaggctctgaggcctcctatgagctgacacagcccaccctcggtgtcagtgtccccagggacagacggccaggatcacctgactctggagatgcagttggacaaagctaatatgcttaactggtaccagcaagaagccaggccacggccccgtgtgggtggtgatataagtaaaggaccggtagacggacggcccgtcggagggactcccctagacggacgtaatcgtctacggactccgagctacgaagggaccaaacgtagtaccacgttacgaacctagtccgaggtacgggactccgaggacaaggaacgacggaggctagactacgtacactagtacaaagtcgacagacagacaacgacggaaacccagtacgggtactggttgggttacgggttacgggacgggtaacgggaaccgtaacggtcgtacgggtaccggtaccgttaacggtccgacggtacccgaacggg

SEQ ID NO: 103101 - DNA, 535 bp, Homo sapiens
  misc_feature: GYAE6OF02IL1UG.3.34.D01.1.454.CMB.1.raw
  modified_base (358)..(358): a, c, t, g, unknown or other
  misc_feature (358)..(358): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatcctctggcctccagctcgagggacaanagtcacgttgaccatcagtggagtccaggcagaacgacgaggctgactatacactgtacaaatgacagacagacaaatcggaacccaagtacgggacttggtaggttcggttcgggacggaacggggacccaaggccgtacggacccgtaccgtaaggtctacgaccccgtaacggg

SEQ ID NO: 103102 - DNA, 525 bp, Homo sapiens
  misc_feature: GYAE6OF02JAMRY.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtggtggtgatataataaagaccgtgagaggccctgagggactcccgtgagcgaatctctggctccagctcgagggacaacagtacacgttgaccatcagtgagtccaggcagaagacgagctagactatcactgtacaaagtagacagacagacaagtacggaaacccagtacgggcttggtggtcggttcgggacggaggaccgagccgtacggacccgtacgtaacgcgacggaccctaacggg

SEQ ID NO: 103103 - DNA, 748 bp, Homo sapiens
  misc_feature: GYAE6OF02IDIF3.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactcacctgctctggagatgctattggacaaagtctatatgcttactggtaccagcagaacgccgaggccacggcccctggtggtgtgatataataaagaccgtgagacgccctgagggtactccccgtgacgacgaacttccgtcgtcggcctccagctacgagggaaccaaacgacgtaccgaacggtttcgaaccctaagtccgaagggttcgggaacgttacccgaagggtaccaaagggaaacggtaccggaagggtacccgttaacggtaaaccttaacgttaccgaaacgtttaggtaaccctaaaaagttaccgaaccgaaacggaaccgaacgggtaacctaaaacggttaacccgggaaaacccctaagggttaaaccggggtcgttacggggtttacggggttacgggtttacccggggggaaccgggtaaccgggggaaacccgtaaacgggtcccggttaaccgggtaaccccggtttacccggtaaacggtttaccccgaacccgggtaccccgtaaacccgggg

SEQ ID NO: 103104 - DNA, 524 bp, Homo sapiens
  misc_feature: GYAE6OF02HM6YM.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggatcccgtgagcgaatctctggctccagctcgagggacaacagtcacgtttgaccatcagtggagtccaggcagaagacgaggctgactatcactgtacaaatagacagacagacaaatcggaaacccagtacgggctggtggtcggttcgggacgggagggaccaaggccgtaggacccggtacctaaggtccgacgcccgaacgg

SEQ ID NO: 103105 - DNA, 582 bp, Homo sapiens
  misc_feature: GYAE6OF02G5KAV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtagagacggccctcgagggactcctgagcgaatctctggctccagctcgagggacaacagtcacgttgacctatcaggtggagtccgaggacaaggaagacggaggctagactactcgactgtacaaagtagacaagacagacaagtacggaaacccagtacgggtcgtagggttggtacgggtttccgggaccgggtaacggggtaacccgaagggtccgttaacgggtacccggttaccgttaaacgggtacccaaccggtaccccggtaaaccgggg

SEQ ID NO: 103106 - DNA, 537 bp, Homo sapiens
  misc_feature: GYAE6OF02FRH37.3.34.D01.1.454.CMB.1.raw
  modified_base (313)..(313): a, c, t, g, unknown or other
  misc_feature (313)..(313): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctnagggatcccctgagcgaatctctggctccagctcaggggacaacagtcacgttgaccatcagtggagtccaggcagaagacgaggctgactatcactgtacaaatagacagacagacaaagtcggaaacccagtacgggcttggtgggtagttcgggacgggaaggggaacccgaaggccgttacgacccggttaccgtaacggtccaacggccccgtaacggg

SEQ ID NO: 103107 - DNA, 567 bp, Homo sapiens
  misc_feature: GYAE6OF02G2WYX.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccgaggcagaagacggagctcgaactatcgactgtacaaatgacagacagacaagtaccggaaacctaggtacgggtacgttgggttagggttacggttcggggacggggtaacggggaaccgtaaacgggtccgtaccggtaacccggttacccgtaacggtaccgtaccggtaccccgtaaccggg

SEQ ID NO: 103108 - DNA, 530 bp, Homo sapiens
  misc_feature: GYAE6OF02GRPNW.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagacggccctcgagggactcccgtgagcgaatctctggctccagctacgagggacaacacgtcacgttgaccatcagtggagtccaggcagaagacgaggctagactatacactgtacaaagtagacagacagacaagtacggaacccagtacggcgtggtcggtggtcgggacgggaagggaccgaagtcgtacggaccgtccgtaacgtcgacgcccgtaacggg

SEQ ID NO: 103109 - DNA, 540 bp, Homo sapiens
  misc_feature: GYAE6OF02G5XFL.3.34.D01.1.454.CMB.1.raw
  modified_base (420)..(420): a, c, t, g, unknown or other
  misc_feature (420)..(420): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtgggtggtgatataataaagaccgtgagacggccctcgagggactcccgtaggagcgaactctcgtggctccgagctcgaagggacaacgagtcacgttgaccatcagtggagtccaggcaagaagacgagctagactancatgtacaatagacagacagacaagtacggaaccaagtacgggctggtaggtcggttcgggacgggaagggaccgaagccgtacggaccggtaccgtaaggtaccgacgacccgtaacgg

SEQ ID NO: 103110 - DNA, 617 bp, Homo sapiens
  misc_feature: GYAE6OF02G2BML.3.34.D01.1.454.CMB.1.raw
  modified_base (504)..(504): a, c, t, g, unknown or other
  misc_feature (504)..(504): n is a, c, g, or t
tcagagacgcactccacgaccggtgctcgattttagatcgtctgtggttcgggtttgggggtcgggtccgaggacggcagaacttctgggtgttctcaccatggcctggatccctctacttctccccctcctcactctctgcacaggctctggtaggcctcctatgtaagctgacacagccaccctcggtgtcagtgtccccagggacagacggccaggactcgacctgctctggacgatgcagttcggcaaaggcttatatgcttactggtaccagcagaagccaggccaggcccctgtgggtggtgattagtagtaaacgaccgtagaggacggtccctcgaggggactccccgtaggaacgcgtaaacttcgtccgtcggtcctaccgacggccgtacgacggggaaccaacgacgtacgaccgtttacgaccctataccaggtacggacgttccgaggcaagaaagacggaggctagactagtcacgtgtacaaatcganagacagacgaatacggaaccagtacgggactaggtggtacggttcggacgggtaaggaccgaacggtcgtacggtacccgtaccgttaacggtccgacggtacccgtaaccgg

SEQ ID NO: 103111 - DNA, 537 bp, Homo sapiens
  misc_feature: GYAE6OF02GDJL2.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccacggcccctggtggtggtgatatataaagaccgtgagacggccctcgagggactcccgtgacgcgaatctctggctcagctcgagggacaacgagtcacgttgaccatcgagtggacgtccgaggcaaggaagacgaggctagactatcactgtacaaatagacagacagacaaagtcggaaaccagtacggcgtggtaggtcggttcgggacgggacgggaaccgaggcgtacggaccgttacgtaagtcgacgacccgtaacgg

SEQ ID NO: 103112 - DNA, 551 bp, Homo sapiens
  misc_feature: GYAE6OF02HD7EW.3.34.D01.1.454.CMB.1.raw
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctggagatgcattggacaaagctatatgcttactggtaccagcagaacgccaggccaggcccctgtggtgtgatanataaagccgtgagaggccctgaggactccctgagcgaatcctcgtggcctccancctgagggacaacgagtcgacgttgaaccagtcgaagtggacgtccgaggacaaggaaacgacggagctagaactactcacttagacaaagtagacagacagacgaaactcggaaacccgagtaacgggcttagggtggtaggtccgggacgggaagggtaccaagcgtacggaacccgtactaaggtcaccggcctaacgg

SEQ ID NO: 103113 - DNA, 529 bp, Homo sapiens
  misc_feature: GYAE6OF02GSXEG.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggactcccgtgagcgaatctctggctccagctcgagggacaacagtcacgttgaccatcgagtggagtccgaggcagaagacgaggctgactatcactgtacaaatgacagacagacaatcggaaacccaagtagggctggtggtggttcgggacgggaagggaccgaaggcgtacggacccggtaccgtaacggtccgacgacccgtaacgg

SEQ ID NO: 103114 - DNA, 530 bp, Homo sapiens
  misc_feature: GYAE6OF02GYX86.3.34.D01.1.454.CMB.1.raw
  modified_base (421)..(421): a, c, t, g, unknown or other
  misc_feature (421)..(421): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctatatgcttactggtaccagcaagaagccaggccaggcccctgtggtggtgatatataaagaccgtgagacgccctcgagggactcccgtgacgcgaatctcgtggctccagctcgagggacaacagtacacgtttcgaccatcagtggactccgaggcaagaagacgaggctagactacncactgtacaaatgacagacagacaagtcgaaaccagtagggctggtggtcggtcgggcggacgggaccacggcgtacggtaccgtacgtaagcgtacgacccgtaacgg

SEQ ID NO: 103115 - DNA, 530 bp, Homo sapiens
  misc_feature: GYAE6OF02FKGNQ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatatataaagaccgtgagaggccctcgagggactcccgtgacgcgaatctcgtggcctccagctcgagggacaacgagtcacgttcgaccatcaggtggacgtccgaggcgaagaagacgaggcagactatcacgtgtacaaatagacagacagacaagtacggaaacccagtaggcttggtggtcggttcgggacggaggaccaagcgtacgaccgtacctaaggtccacgcccgtaacgg

SEQ ID NO: 103116 - DNA, 601 bp, Homo sapiens
  misc_feature: GYAE6OF02I2P7Z.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccaccgtgctctggagatgcattggcaaagctatatgcttactggtaccagcagaacgccgaggccacggcccctggtggtggtgatataataaacgaccgtgagacggccctcgagggctcccgtgagcgaactctctcgcctcgagctgacgggacaacgagtcgtacgtacgacctatacgaggtacggacgtccgaggtacaacggaagacgaggtactacgtactatccgaactcgaactaaagtacgacgtaacgaacagactaaagtaccggaaaccctagtaacgggtcgttggtacgggttacgggttccgggacgggtaacgggaaccgtacggtacgtacgggtacccggttacgtaacggtccgacgacccggtaaccggg

SEQ ID NO: 103117 - DNA, 515 bp, Homo sapiens
  misc_feature: GYAE6OF02GKUYV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggactccctgagcgaatctctggctcagctcagggacaacagtcacgttgaccatcagtggagtccaggcagaagacgagctgactatcactgtacaaatgacagacagacaagtcgaaacccagtagggcttaggtggtcgttcgggacggtagggaaccaaggctacggaccgtaccgtaagtccgacgccctaacgg

SEQ ID NO: 103118 - DNA, 505 bp, Homo sapiens
  misc_feature: GYAE6OF02HRYYP.3.34.D01.1.454.CMB.1.raw
  modified_base (293)..(293): a, c, t, g, unknown or other
  misc_feature (293)..(293): n is a, c, g, or t
  modified_base (369)..(369): a, c, t, g, unknown or other
  misc_feature (369)..(369): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatanaaagaccgtgagaggccctcgagggatcccgtgagcgaatctctggctccagctcgagggacaacagtcaacgttnaccatcagtggagtccaggcagaagacgagcgtagactatcatgtacaaatagactagacagcaatggaacccagtagggctggtggtgttcggcggagggaccagctagaccgtctaacgctacgaccctaacgg

SEQ ID NO: 103119 - DNA, 591 bp, Homo sapiens
  misc_feature: GYAE6OF02JDYV8.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcgagggactcccgtgagcgaatctctggctccagctcgagggacaacagtcacgttgaccatcagtggagtccgaggcaagaacgacgaggctgactatcactgtacaaatgacagaacagacaaagtacggaaaccctagtaacggggtcttagggtcgggttacgggtttaccggggaccgggtaaacgggggaacccgtaaacgggtcccggttaacggtaaccccggtttaacccgtaaaccggttacccggaaccggacccccggtaaacgggg

SEQ ID NO: 103120 - DNA, 533 bp, Homo sapiens
  misc_feature: GYAE6OF02HFGZ7.3.34.D01.1.454.CMB.1.raw
tcagagacgcactccacgaccggtgctcgatttagatcgtctgtgttgggtttgggggtgggtccaggaggcaaaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattggacaaagctatatgcttactggtaccagcagaagccaggccaggcccctgtggtggtgatatataaagaccgtgagaggccctcgagggactccctgagcgaatctctggctccagctcagggacaacagtcacgttgaccatcagtggacgtcgaggcaaggaagacgaggctagaactatcactgtacaaatagacaagacagacaagtcgaacccagtagggctggtggtggttacgggcgggaacgggaccgaaggtccgtaggacccgtccgtaagtccgaacgacccgaggtcccg

SEQ ID NO: 103121 - DNA, 315 bp, Homo sapiens
  misc_feature: GYAE6OF02GZQ04.3.34.D01.1.454.CMB.1.raw
  modified_base (307)..(315): a, c, t, g, unknown or other
  misc_feature (307)..(315): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnnnn

SEQ ID NO: 103122 - DNA, 559 bp, Homo sapiens
  misc_feature: GYAE6OF02G7H7K.3.34.D01.1.454.CMB.1.raw
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaacgccaggccaggcccctgtggtggtgatatataaaggaccgtgagacggccctcgagggactccctgagcgaactctctggctccagctcgaggacaacagtcacgtacgaccatcgagtggagtccaggacagaagacggngactgactancactgtacaaagtgacagacagactaagtacggaaacctagtagggtctggtggtacggttcgggacgggaacgggaaccgtaacggtccgttaccgggtaacccgtacccggttaacggtacccgaccggtacccgtaaccggg

SEQ ID NO: 103123 - DNA, 724 bp, Homo sapiens
  misc_feature: GYAE6OF02JZL8Z.3.34.D01.1.454.CMB.1.raw
  modified_base (224)..(224): a, c, t, g, unknown or other
  misc_feature (224)..(224): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagccacccgtcggtgtcagtcgtccccaggacagacggccaggatcacctgctcgtgganatgctagttggacaaagctatatcgacttacgtacggtaccagacaaggaacgccgaacggccgaacgggtcccctggtcgggtggtacgtaattaagtaacgtaaaacggaccggttaggaacggtacggtccccgtacggaacgggtacctacccgtaggacgtacgtaactccgtcgtcggccttaccgagtacgtacgaacgggaaccaacgtacgtacgtacgttacgacctagtacgacggtacggacgtaccgaggacgaaaggaacggacggagcgtacgtacgtacgtacacgtacgtaactaagtacgacgaacgacgacgtacgtaaaccgtacggaaaccgtagggtaacggtacgttcgggttacgggtttaccgggtacggggaaccggggtaaacggtaacccggtaacgggtaccgttacccgggttaacccggttaacccggttaacgggtaccccgtaaccgggtaccccggtaaaccgggg

SEQ ID NO: 103124 - DNA, 913 bp, Homo sapiens
  misc_feature: GYAE6OF02H6L5Q.3.34.D01.1.454.CMB.1.raw
tcagagacgcactccacgaccggtgctcgatttagatcgtctgtgttaggggtttaggggggtgggtccaggaggcagaaacgtctcgggtgtcctcgacctatgggccttggattcccgtctacttctccccctcctcaactctctgacacaggctcgtgtaggccttcctatgagttctgacactagtaccaccctcggtgtcagtgtcccaggacagacggccaggactcggaccgtgctcgtaggacgtagtcgcgtagttcggacaaacgctatagtcgtcctttacgtcggtaacctacgtaccgtaaggtaacgtaccgacgggaccccgacggttcccccggtttagggttcggggttaccgggttacggtaaacgttaaacgttaaacggttaaaaccggggtaacccgggttaggaacgggtaaccgggttaccccggttacggaacggggtaccgttccccgtagggtacggtacggtaacgttccgttaccgtcggaccgtaccgaacgtacgttaaccggaaacggggtaacctaacggtacggtaccggtaccggtttaccgtaaccttaagtccgtaacggtacgggtaacgtacccgtaacgggtaccgaaacgggaaacggtacggtaacggtacgttaacgtaccttacgtaccgtaacgttacgtaaaccgtaacgttacgaaccgtaaggaaccgaacggtaaccgtaaaccggtaaccgggtaaaacccgtaaggttaacgggttacgttagggtttacggggttaacgggttaccggggaaaccggggttaacggggtaaacccgttaaccggtacccggtttaaccggttaaccccgggttaacccgggttaacccgggtaccggtacccgggtaacccgtaacccgggg

SEQ ID NO: 103125 - DNA, 497 bp, Homo sapiens
  misc_feature: GYAE6OF02F24UV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggcctcagggatccctgagcgaatctctggctccagctcagggacaacagtcacgttgaccatcagtggagtccaggcagaaagacgaggctgactatcactgtacaaatagcagacagcaatggaacccagtaggctagtggtggttcggcggagggaccagctgaccgtaccgtaagtcagcccaacgg

SEQ ID NO: 103126 - DNA, 749 bp, Homo sapiens
  misc_feature: GYAE6OF02GWNO1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccctcggtgtcagtcgtccccaggacagacggccaggatcacctgctctggagatgcattggacaaaagctaatatgtcttactggtaccagcagaagccaggccacggcccctggtggtggtgataataagtaaacgaccgtggagacggccctcgagggtactccctggacgacgaatctacgtcggcctaccgagcctacgaacgggaaccaaacgtacgtaccgtaccggtttacgaccctagttaccgaagggttacgggacggtacccgaagggaccgaagggaaacggaacggtacggacgttacgaacttacgtaccgtaacgttcgtaaacaaaagtacgaaccaaggaacccaaggtaaccgtaaacgtaaaccgggtaaaaccccgtaaagggtaccggggtaacgtttacggggttcggggtttacggggggtttaacccggggaccgggggtaaaccggggggtaaaccccgtaaacgggtcccgtaaacccggggttaacccccggtttaacccggtaaaccgggttcccgtaaacccgggtaacccccgggtaaacccgggg

SEQ ID NO: 103127 - DNA, 823 bp, Homo sapiens
  misc_feature: GYAE6OF02HI0ME.3.34.D01.1.454.CMB.1.raw
tcagagacgcactccacgaccggtgctcgatttagatcgtctgtgtggggttggggtggtccaggaggcaggaactcctgggtcgtcgtctaccagtggtcctggtagtccctctacttcgtccccctcctacactctctagccacaggtcgtcgttggacgcctcctatggagttcctgacgactagtacccgacccgtccggtgtcaggtcggtaccccgaggacgacgacggccgaggactaccgaccgggtgccttcggtaggacgtacgtcgggtacctagttcggaactaacgtcctatagtcgtacttaccgtacggtaaccgagtaccgaacgtacggccgtacggaccgtacggtcccttaggtgggtggtacgtaggttaacgtaacgtaaaccggccgtacggaacggtaccggtcccgaggtacgggtaccgttccggtagacggtacgtaacttcgtacggtcggtacctaccgatacgtacgtacgggaaccaacgtaccgtacgtacggtaacgacccgtattacggacggtagtacccgacggtacggactaaacggaacggtaccggaagtaccgtaacgtacttacgtacctacgtacgtaaactaaacgtcggaaacgacgtaaccgtacgaaacggtaaccgggaacccggtaaaccgtaacgggttacccgggtaaccgttagggtttacgggttaccgggttaaccggggaaaccgggtaaacggaacccgtaacgtccgggttaacccgtacccgggttaaccgtaccggtaaccggacccggaaccccgttaaccgggg

SEQ ID NO: 103128 - DNA, 548 bp, Homo sapiens
  misc_feature: GYAE6OF02IZ9II.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctaatatgcttactggtacagcagaagccaggccaggcccctggtggtggtgatatataaagaccgtgagacggccctgagggactccctaggacgcgaaatctctgggcctacgagcctacgaacggggacaaacgagtacctacgtttacgaccactctaggtaggacgtccgagcgagaaggacgaggactgactactcactgtacaaatacgacaagtacagacaatacggaaccagtaggactgtaggtggttcggcgggtaggaaccgagacgtcgaccgtacgtacgtcgacgccgtaaccgg

SEQ ID NO: 103129 - DNA, 726 bp, Homo sapiens
  misc_feature: GYAE6OF02HO6G4.3.34.D01.1.454.CMB.1.raw
  modified_base (586)..(586): a, c, t, g, unknown or other
  misc_feature (586)..(586): n is a, c, g, or t
tcagagacgcactccacgaccggtgctcgatttagatcgtctgtgttgggtttggggtgggtccaggaggcagaactcgtgggtgtctcaccatggcctggatcctctacttctcccctcctcactctctgcacaggctctgaggcctcctatgacgctgacacacgccctacccgtcggtgtccagtcgtccccaggacagacggccaggatccacctgctacgtggagattcgacgtaattcgggactaaaacgtcttaagttatcgtacctttaacgttggtaacccaagcgtaagaacgccgaggacccaacggtccccgtggttggtacggtagaacgttaagtaaagtaaacgacccgttaggaacgacggtccccgtacgaagggtaacctccccgttaaggataaaccggtaactttcccgtcgttacgggccttacccgaacggcttaccgggaaggtaacccaaactacggttacctaccggtttaccgaaccctaagtactacgggttacggtaacgtacccggtagggaccaagggtaaacgacggtacgacgttacgtactacacgtaaccgngtaactaaacgtacgagacgtacgacgtaacgacgtaccggaacaggtacggtacttagggtcggtttacggaaccgggtcggaacggttaaccggaattccggacgtaccggtactacggacgtaccgacccgtaacgg

SEQ ID NO: 103130 - DNA, 774 bp, Homo sapiens
  misc_feature: GYAE6OF02IDOX2.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggactcacctgctcgtggagatgcagttggacaaagctatatgcttacgtggtaaccagcagacgccgaggccacggtccccctggttgggtggtacgtaattaattaaagtaaaacggtaccggttaggaacgggtacgggtccccgttacggaacggggtaccttaccccgtggaacgaccggtaaacttccgttcgtcggtccgttacccgacggtcctacggaacggggaaccaaaccgtacggttaccgtaacgggttttccggaaaccctagttacccggtaagggttacgggacggttacccgaagggacccgtaaagggtaaacggacgggaaacgggtccgttaacggtaaccttagtaaccgtaactacggtaacaaaagttacgacgaaacggtacgaacgtaacgtaacgtaacggaaacccctaaggtaggggtacctaggggttagggttccgggttaaaacgggggccgggaacgggtaacccggtaaacggtccggttaacgggtaccccggttaaccgttaacgggtacccgtaccggtacccgtaaccggg

SEQ ID NO: 103131 - DNA, 601 bp, Homo sapiens
  misc_feature: GYAE6OF02GSHHY.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccacggcccctgtggtggtgatataataaagaccgtaggaggacggccctacgagggactcccgtggagcgaatctcgtggcctccagctacgacgggaacaaacgtacgtaccgtacgttacgaacctagtaccgaggtacgggacgtccgaaggacgaaggaacggacggaggctagactatacgacgtacgtaacaaagtacgacagaacagacaaagtcggaaaccctaggtacggtcgttggtggtacgggttcgggacgggtacgggaaccgacggtaccgtacggtaccgttaccgtaacggtaccgaccggtacccgaaccggg

SEQ ID NO: 103132 - DNA, 658 bp, Homo sapiens
  misc_feature: GYAE6OF02IFX8C.3.34.D01.1.454.CMB.1.raw
  modified_base (255)..(255): a, c, t, g, unknown or other
  misc_feature (255)..(255): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctagaaacagccaccctcggtgtcagtgtccccaggacagacggccaggatccacctgctactggagatgcagttggacaaagctatatgcttacnggtaccagcagaagccaggcctacggccctgtggtggtgaatataagtaaacgaccgtgaagacgcccctgacgggatcccgtgacgcgaatctctggctccgagtcctacgagggaccaaacgtcgtactacggttacgaacctactacgaacggtgggtacgtaccgacggacgaagggaaagtacggacggtactggaaactttaacgtacacgttacggttaaacaaacgttacggaacgtaacgaacgtaacgaaccgtaaacgtaaccggaaaccgtaacggtaacgggtcgttaggttcggttacgggtacggggaaccgggaacggtaaccgtaacgtaccgtaccggtaaccggtaccttaaacggtaccgtaccggtacccgtaaccggtccg

SEQ ID NO: 103133 - DNA, 685 bp, Homo sapiens
  misc_feature: GYAE6OF02JIBH7.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctctcactctctgcacagctctgacggcctctagtgagctgacacagccacctcggtgtcagtcgccccaggacagacggccaggactccactgactctaggagatgctagttggactaaaggctatatcgtacttacgtaggtaccagacgagaacgccgacggaccacggtcccctggtggtaggtagagtaatagtaaagacgtgacggacgcctagacggactcccgtaggacgtcgtaactcgtcgtcggccttaccgagacgtacgaacggacaaacgtacgtccgtaacggtttacgaacctactaccgtaaggttcgggacttaacccggaagtacgaaggaaacggtacggagtacgttacgacttaacgtactaccgtagtaactaaacgtacggacctaagaaccgaagtactaaacgtacggaaaccgtagtaaccggggtcttacgggtaggttaccgggttaccgggaacgggttaaacgggaaccgtaacggtacgttaacccggttaaccggtacccggttaacggtacccgaaccggtacccggaaccgg

SEQ ID NO: 103134 - DNA, 533 bp, Homo sapiens
  misc_feature: GYAE6OF02HD3CO.3.34.D01.1.454.CMB.1.raw
  modified_base (369)..(369): a, c, t, g, unknown or other
  misc_feature (369)..(369): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagagccaggccaggcccctgtggtggtgatatataaagaccgtgagaggccctcgagggactccccgtgagcgaatctctggctccagctcagggacaacgagtcacgttnaccatcagtggagtccgaggcagaagacgagctagactatcactgtacaaatagacagacagacaatacggaaacccagtacgggactggtggttcggttacgggacggtagggaaccaaggtcgtacggacccggttctaacggtccgacggaccctaacggg

SEQ ID NO: 103135 - DNA, 614 bp, Homo sapiens
  misc_feature: GYAE6OF02JV91R.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgctattggacaaagctatatgcttactggtaaccagcaagaacgccgacggccacggccccgtggtggtggtagagtataagtaaacggaccggtagacggacggcccgtagagggtactcccgtagacgacgtaatctacgtcgacctccgagtctacgaagggtaccaacgtacgtaccgtacgttacgacctagtaccgaggttcggacgtcgaggacaagaacgcgaggctagtactagtccactagacaagcgacaagacgagacgaaacgtcggaaacctagtaacggtctaggttcgggtacgtacggggacgggaacgggtaccgacggtaccggtccggtaacccggttaccgtaacggtccggaccgacccggtaacgg

SEQ ID NO: 103136 - DNA, 700 bp, Homo sapiens
  misc_feature: GYAE6OF02JXLD2.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatcgcttactggtaccagacaagaacgccaggccacggcccctaggtggtgggtgaattataagtaaaacgaccggtagaacgacgggcccctaggaacggggaccttaccccgtaggacggaccggtaacttccgtacgtcggaccttcccgaaggcctacggaacgggaaccaacgtacggtacctaacgttccgaaccacttacgaggtacggacggtacccgaaggcgaaggaacggacggacggacttaacggacttaactaccgtacgtacggtaactaaaagtacggaccaaacgggtaacctaaacggaccgtaaaacgggtaaccggaaacccgtagttacgggttccgtagttcgggttacgggttacggggaaccgggttacgggaaccgtacgggtcgtaaccggtacccggttacgtaacggtacccacggtaccccgtaacggg

SEQ ID NO: 103137 - DNA, 532 bp, Homo sapiens
  misc_feature: GYAE6OF02GV7ZP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatgcttactggtaccagcagaagccaggccaggcccctggtggtggtgatatataaagaccgtgagacggccctcagggactccctagagcgaatctctggctccagctcgagggacaacgacgtcacgttacgaccagtaccagtggactccgaggcaagaagacggaggctagactatacactagtacaaagtacgactagacagacaagtacgaaccagtacgggcttggtggtcggttcgggcggacgggacaagtcgacgccgtacgtagtcacgaccgtaacgg

SEQ ID NO: 103138 - DNA, 523 bp, Homo sapiens
  misc_feature: GYAE6OF02HY9AK.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagagccaggccaggcccctgtggtggtgatatataaagaccgtgaggacggccctcgagggactccccgtgacgcgaatctctggctccagctcgagggacaacagtcacgttcgaccatcgagtggacgtccgaggcaagaacgacgaggctcgaactatcactgtacaaatgacagacagacaatcggaaacccagtacgggctggtggtggtcggcggaggaccaaggtctacggaccgtccgtaagtcgacgccgtaacgg

SEQ ID NO: 103139 - DNA, 535 bp, Homo sapiens
  misc_feature: GYAE6OF02G6IPH.3.34.D01.1.454.CMB.1.raw
  modified_base (224)..(224): a, c, t, g, unknown or other
  misc_feature (224)..(224): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattggacaaagctatatgcttactggtaccagcagaagccaggccacggcccctgtggtggtgatatataaacgacgtgagacggccctgagggactcccgtgagcgaatctcgtggctccgagctcgaggacaaacgtagtcacgttcgaccagtccgaggtggacgtaccgaggcaaggaagacggtagcgtagactactcaactgtacaaagtgacagacagacaagtcgaaccagtaggcgtgtaggtggtcgggacggacggaccgagcgtacgtaccgacgtacgacgacgacccgaacgg

SEQ ID NO: 103140 - DNA, 529 bp, Homo sapiens
  misc_feature: GYAE6OF02FQLRN.3.34.D01.1.454.CMB.1.raw
  modified_base (315)..(315): a, c, t, g, unknown or other
  misc_feature (315)..(315): n is a, c, g, or t
  modified_base (441)..(441): a, c, t, g, unknown or other
  misc_feature (441)..(441): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatgcttactggtaccagcagaagccaggccaggcccctggtggtggtgatatataaagccgtgagaggccctnagggactcccgtgagcgaatctctggctcagctcgagggacaacagtcacgttagaccatacgagtcggagtccgaggacaggaagacgaggctagactatcatgtacaaatgacagacagacaanacggaacccagtacgggctggtcggtaggttcgggacgggaacgggaaccgagcgttcgaaccggtccgtaaggccacggcctaacgg

SEQ ID NO: 103141 - DNA, 591 bp, Homo sapiens
  misc_feature: GYAE6OF02HUGQ8.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcagttggacaaagctatatgcttaactggtaccagcagaagccaggccaggcccctgtggtggtgatatataaagaccgtgagacggccctcgagggactccctagacgcgaatctcgtggcctaccagtctcgagggaacaacgacgtcacgtttcgaacctatcgagtggacgtccgaggacaaggaacgacgaggctaggaactatccacgtagtactaaagtacgacaagaacaagacctaaagtaccggaaaccagtacgggacttagggttaggtcgggttacgggcgggaaacggggaacccgaaggtccgtacggtacccggttaccgtaaaggccgtacggaccccgtaaccggg

SEQ ID NO: 103142 - DNA, 538 bp, Homo sapiens
  misc_feature: GYAE6OF02FZYMT.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggcccctgtggtggtgatatataaagaccgtgagacggccctcgagggactccctgagcgaatctctggctccgagctcgacgggacaacagtcacgttgaccatcagtggagtcaggcagaagacgaggctgactatcactgtacaaatagacagacagacaaagtcggaaacccagtacgggctggtaggtcggttcgggacgggtacgggaaccgtaagccgtacggtacccgttaccgaaggtccgacgtcccgtaaacggg

SEQ ID NO: 103143 - DNA, 658 bp, Homo sapiens
  misc_feature: GYAE6OF02JLNQ9.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacacgacggccaaggactcaccgtgctcgtggagatgactattcggacaaagctatatgcttacgtggtaccagacaagaacgcgaggccacggccctggtggtggtagataataacgtaaacgccgtagaggacgtcctgacggactccgtagacgacgaatctcgtcggctccagctacgacgggaacaacgtcgtacgtaacgtcgaacagtacgagtcggacgtcccgaaggactaaggaacgacgggagacgtacggaacctataccgtacgtagtaaccgaaagtacgacgaacgtaacacggaactaaacgtacggaaaccctaggtacgggttactacgggttcgggtagggttacccggggacgggtaacgggtaaccgtaacgggtaccgtaaccggtacccgggtttaaccggtaaacggtaacccggtaccgggtaaccccgtaaaccgggg

SEQ ID NO: 103144 - DNA, 311 bp, Homo sapiens
  misc_feature: GYAE6OF02GW07H.3.34.D01.1.454.CMB.1.raw
  modified_base (307)..(311): a, c, t, g, unknown or other
  misc_feature (307)..(311): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnn

SEQ ID NO: 103145 - DNA, 572 bp, Homo sapiens
  misc_feature: GYAE6OF02F5GGV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaaagctatatgcttactggtaccagcaagaagccaggccaggccccctgtggtggtgatataataaagaccgtgagacggccctcagggatcccgtgagcgaatctctggctccagctcgagggacaacagtacacgttgaccatcgagtggagtccgaggacgaagaagacggaggctagactatcactacgtacaaagtacgagagacacgacaagtacggaaaccaagtacgggcttaggtggttacggtttccgggacgggtaacggggaaccgaacggtaccgtacggtaccccgttaccggtaacggttccgaacggtaccccggtaaccggg

SEQ ID NO: 103146 - DNA, 730 bp, Homo sapiens
  misc_feature: GYAE6OF02HS542.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatgcttactggtaccagcaagaacgccaggccacggcccctgtggtggtgatatagtaaagaccgtagaggacggccctacgagggactccccgtaggacggacgtaaactcgtcgttacggcctccgaagcctacggaaggggaaccaaacgtacggtaccgtaacggtttacgaaccctagtaccgaagggttcgggaacgtacccgaagggacgtaaagggaaacggaacggaacgggtaccgttaacggaaccttacgttaccgaacgttagttaaccgaaagtaccggacgaaacggaacgaagtaaccgtaaagttaacccgggaaaccctaaggttaaccggggtacgttacgggtttacggggttacgggtttccgggggaccggggtaaacggggtaaccccgtaaagggtacccgttaccgggttaacccggttacccggttaaacgggtacccgtaaccggaccccgtaaaccgggg

SEQ ID NO: 103147 - DNA, 543 bp, Homo sapiens
  misc_feature: GYAE6OF02HSX05.3.34.D01.1.454.CMB.1.raw
  modified_base (222)..(222): a, c, t, g, unknown or other
  misc_feature (222)..(222): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattggcaaagctatatgcttactggtaccagcagagccaggccaggcccctgtggtgtgatatataaagccgtgagaggccctcgagggatccccgtgacgcgtaatctcgtggctccagctcgagggacaacacgtcacgttgaccatcgagtaggagtccgaggacagaagacgaggctagactatcactgtacaatagacagacagacaagtcggaaacccagtacgggcgttggtggttaggttcgggacgggtacgggaaccgtaaggcgtacggaacccggtccgtaacggtccgtagaccccgtaacggg

SEQ ID NO: 103148 - DNA, 606 bp, Homo sapiens
  misc_feature: GYAE6OF02GTFN4.3.34.D01.1.454.CMB.1.raw
  modified_base (372)..(372): a, c, t, g, unknown or other
  misc_feature (372)..(372): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagaccggcaggatcacctgctctggagatgcattggcaaagctatatgcttacgtgtaccagcagaagccaggccaggcccctggtggtggtgatagtaataaagaccgtgaagacggcctcgagggactccctgacgcgaatctcgtggcctccgagctcgaaggggaccaaacgngtacacggtttacgacctatacgagtcggacgtaccgaaggacgtaggaacgacggaacggctacgactagtaccacgttgtaaccgaaatacgactacggaactacggaacaaagttccgggaaaccctagtaacggggcgtagggttaggtcggtttacgggacgggttacggggaacccgtaaggccgtacggtacccggttacgtaaacggtccgacgtcccgtaacggg

SEQ ID NO: 103149 - DNA, 558 bp, Homo sapiens
  misc_feature: GYAE6OF02G0RJD.3.34.D01.1.454.CMB.1.raw
  modified_base (415)..(415): a, c, t, g, unknown or other
  misc_feature (415)..(415): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccccgtgagcgaatctctggctccagctcgacgggacaacgagtcacgttcgacctatcgaggtggacgtccaggcagaacgacgagctagactancatgtacaaatgacagacagacaacgtacggaacccagtacgggcttaggtcggttacggttccgggacgggtaacgggtaacccgtaaggccgttacggtacccggttaccgttaaacggtccgacggtaccccgaaccggg

SEQ ID NO: 103150 - DNA, 781 bp, Homo sapiens
  misc_feature: GYAE6OF02H843J.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggatcacctgctcgtggagatgcagttggacaaagctatatgcttacgtggtaccagcaagaagccgaggccacggtccccgtggtggtggtagattataagtaaaacggtaccgtagaggacggccctacgaacgggacttcccgtaggacgacggaactccgttacgtggacctccgagctacgacgggtaacaaacacgttaccgtaacgtttacgacctaagtcgtaaggtacgggacgtacccggaaggacgaaacgggaaacggtaccgggtaagggtacccgtaaggttaacctaaacgtttaccgaaaccgtttaggtaaaccgtaaaagttaaccggaaccgaacggaaaccgaacggaaccgttaaaaacgggtacccgggtaaaacccctaaggggtttaaccgggggaccggtttaggggtttccggggtttacgggggtttacccgggggaaccggggtaaccgggggtaaaccccggtaaacgggttccccggttaccggtaaccccgggtttaaccggttaaaccggttacccggacccggttaaccccggtaacccgggg

SEQ ID NO: 103151 - DNA, 527 bp, Homo sapiens
  misc_feature: GYAE6OF02FUITJ.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctgagggatcccgtgagcgaatctctggcctccagctacgagggacaacagtcacgttgaccatcagtgacgtcaagcagaagacgaggctagactatcactgtacaaatgacagacagacaagtacgaaacccagtacgggtctggtggtaggttccgggaggacgggtaccgaacggcgtacggtaccgtccgttaagtcgacgtcccgaacgg

SEQ ID NO: 103152 - DNA, 609 bp, Homo sapiens
  misc_feature: GYAE6OF02ISWPU.3.34.D01.1.454.CMB.1.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtgganatgctattggacaaagctatagtgcttactcggtaccagcgaagaacgccgaggccacggcccctggtgggtggtgattagtaagtaaagaccggtgaaggacggccctcgaggactcccgtgagcgaattccncgtggcctcgacgcgtacgaagggacaactagtactacgttacactatcgaggtggacgtaccgaggacgaggaacgacgagggactaggtacctacgtctactacgtanaaagtcgacaagacagacaacgtaaccggaacctaagtacgggacttgggtcgggttacgggttacgggacgggtaagggaaccgtaacggtccgtaacggtaacccgttcgtaacggtaccgacggacccgtaaccggg

SEQ ID NO: 103153 - DNA, 625 bp, Homo sapiens
  misc_feature: GYAE6OF02GDLF6.3.34.D01.1.454.CMB.1.raw
  modified_base (296)..(296): a, c, t, g, unknown or other
  misc_feature (296)..(296): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctggaggcctcctatgagctgacacagccaccctcggtgtcagtcgtccccaggacagacggccaggatcacctgctctggagatgcattggacaaagctatatgcttactggtaccagcagaagccaggccaggcccctggtcggtgtgatatanaaaagaccgtgagacggcctcgagggactcccgtgacgacgaatctcgtggctaccagctacgaaggacaacgacgtacgacgtttgaaccatacaggtggacgtccgaaggcaagaaaggacgacggtactacggaactaatacgacttaggacctaaaagtacgacaaacgtacaacgacgtaaagtaaccggaaaccgacgtaacggggtccgttagggttacgggttagggttaccgggacggggttaaacggggaaccctaagggtacccggttggtaaccccggttaaccgaacggtaccgtacgggaaccccgtaaccgggg

SEQ ID NO: 103154 - DNA, 525 bp, Homo sapiens
  misc_feature: GYAE6OF02FRYQ9.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattggcaaagctatatgcttactggtaccagcagaagccaggccaggccccctgtggtggtgatatataaagaccgtgagaggccctcgagggactcccctgagcgaatctcgtggctccagctcgagggacaacagtcacgtgaccatcagtggagtccaggcagaagacgaggctgactatcactagtacaaatagacagacagacaaagtcgaaacccagtacgggctggttggtggttcgggcggacgggaccaagcgtacggacccgtaccgtaagtcgacggcccgaacggg

SEQ ID NO: 103155 - DNA, 686 bp, Homo sapiens
  misc_feature: GYAE6OF02JKZV4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattggacaaagctatatcgcttacgtggtaccagcaagaacgccgacggccacggtcccctggtgggtggtgaattacgtaaagtaaacggaccggtagaacggacggtcccctacggaacggggtactccccggtaggaacggtacgtaaacttcctcgtgggtcctccgacgctacggaacgggaacaacgagtccgtacgttagacctagtcgaggtggtacgtaccaggacgaaggaaacggacggaggactacggtaacttacgtaccacgttacgtaacgtaaacgtacgacgaacgtaacgaacggtacgtaaacggttaccggaaaccccgtaaggtacggggtaccgttgggttacgggtcggttaccgggggaccgggtaacgggaacccgtaaggtaccggtacggtacccggttaccgtaacggtaccgacggtacccgtaacggg

SEQ ID NO: 103156 - DNA, 521 bp, Homo sapiens
  misc_feature: GYAE6OF02HFOPX.3.34.D01.1.454.CMB.1.raw
  modified_base (222)..(222): a, c, t, g, unknown or other
  misc_feature (222)..(222): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattggcaaaagctatatgcttactggtaaccagcagaagccaggccaggcccctgtggtggtgatataataaacgacgtgaggacggccctcgagggactccccgtgagcgtaatcctcgtggcctccgagctcgagggacaacagtcacgttgaccatcaggtggtacgccgaggcaggaagacgacggntcgacttancactgacaatagcagacagacaagtcgaaaccagtagggctgtggtggtcggngggacggacgagtcgacgacgtcctaagtcacgaccgaacgg

SEQ ID NO: 103157 - DNA, 539 bp, Homo sapiens
  misc_feature: GYAE6OF02GA7FE.3.34.D01.1.454.CMB.1.raw
  modified_base (265)..(265): a, c, t, g, unknown or other
  misc_feature (265)..(265): n is a, c, g, or t
  modified_base (417)..(418): a, c, t, g, unknown or other
  misc_feature (417)..(418): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagatggccaggatcacctgctctggagatgcattggacaaagctatatgcttactggtaccagcagaanccaggccaggcccctgtggtggtgatatataaagaccgtgagaggccctacgagggactccctggacgcgaatctctggctccagctacgacgggacaacgagtacacgttgaccatcaggtggagccaggcaagaagacgaggctgactannactgtaacaaatacgacagacagacaaagtacgaaccagtaggcttggtgggttcggttcgggacgggtacgggaaccaacggtcgtacggtacccgtacctaacggtccacggtaacccg

SEQ ID NO: 103158 - DNA, 312 bp, Homo sapiens; identical to SEQ ID NO: 103047
  misc_feature: GYAE6OF02GADC8.3.34.D01.1.454.CMB.1.raw
  modified_base (307)..(312): a, c, t, g, unknown or other
  misc_feature (307)..(312): n is a, c, g, or t

SEQ ID NO: 103159 - DNA, 738 bp, Homo sapiens
  misc_feature: GYAE6OF02HZ2UQ.3.34.D01.1.454.CMB.1.raw
  modified_base (182)..(182): a, c, t, g, unknown or other
  misc_feature (182)..(182): n is a, c, g, or t
tcagagacgcactccacgaccggtgctcgatttagatcgtctgtgttgggtttgggggtgggtccaggaggcagaactctgggtgtctcaccatggcctggatccctctacttcctcccctcctcactctctgacacaggctctgaggcctctagtgagctgacacacgccacccgtcggtntcagtcgaccccaggacaggaccggcgaaggactcacctgctcgtaggagatgctagttggacaaagctatatgtacttaaccgtggtaaccagacaagaacgccgaaggaccgacggtccccgttggtgggtaggtagtaattaaagtaaacgtaaaacggtccgtaggaacggtaccggtacccgtacggaacgggtacctacccgtaggaacggtacgtaaactccgttacgtccggtacctaccgaaggtcccttaacggaacgggtaaacctaaacgtaaccggttaccgtaaccggttaacgaaccctaagtacgtagggtacgggtacgaccggaagacgaaagggaacgaacggtaggactacgtaactacgacctacgtagtaaacctaaagacagaacgacgtaacgacgtaaacgtaccggaaaccagggtacggtagttacgggtcggtttcgggacgggtaacgggaacgggttaaccgaaccggtttccggaaccggtaacccgttacccgtaaaggtcccgaaacccgtcccggaaacggg

SEQ ID NO: 103160 - DNA, 672 bp, Homo sapiens
  misc_feature: GYAE6OF02GOKPK.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctcgtggagatgctagttggacaaagctatatgtacttacgtgtaccagcaagaacgccgaacggccacggccccgttgggtcgggtggtagtaacttaagttaaacgtaaaacggtaccgtaggaacggaccggtcccgtacggaacgggacttccccgtaggaacggtacgtaacttcgtccgtcggccttaccgacgtccgtacggaacgggaaccaacgtacgtaccgtacggttacgacccgtagtaccgtaggtacgggtacgtccgaagggacgaaaggaacggacggaggtcgtaacgtactacgtacctaacgttgtaaccaaagtacgacgaagacaagactaacgtacccgaaacgtaggtacggtcgttagggttggtcggtcgggaggaacggaccgtacggcgtacggtaccgttaccgtacgacgaccgaccgtaccgg

SEQ ID NO: 103161 - DNA, 616 bp, Homo sapiens
  misc_feature: GYAE6OF02HKKVP.3.34.D01.1.454.CMB.1.raw
  modified_base (222)..(222): a, c, t, g, unknown or other
  misc_feature (222)..(222): n is a, c, g, or t
tcagagacgcactccacgaccggtgctcgatttagatcgtctgtgttgggtttggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattggcaaagctatatgcttactggtaccagcagaagccaggccaggcccctgtcggtggtgatataataaagaccgtgaggacgccctcgaggactccgtgacgcgaactctacgtcgctaccgacgtcgtcggaagggaaccaacgtacgtacgtaacgtttcgaacctatacgtaggtaggacgtaccgaggacgaaggaacgacggacggctacgaacttacgtactacgtgtaactaaagtacgacgtaacgacgtacgactaacgtaaccggaaaccgtaagtacggtcgttacggtcgggttacggttcggggacgggaacgggtaaccgaacggtcgtaccggtaaccgtaccgtaacgtaccgaccgacccggtaaccggg

SEQ ID NO: 103162 - DNA, 1046 bp, Homo sapiens
  misc_feature: GYAE6OF02JMDRZ.3.34.D01.1.454.CMB.1.raw
  modified_base (225)..(225): a, c, t, g, unknown or other
  misc_feature (225)..(225): n is a, c, g, or t
tcagagacgcactccacgaccggtgctcgatttagatcgtctgtgttgggtttgggggtgggtccgaggaggcgagaactctgggtgtctcaccatggcctggatccctctacttctcccctcctcactctctgcacaggctctgaggcctcctatgagctgacacagccaccctggtgtcagtcgtccccaggacagacggtccaggatccacctgctctgganatgctatggacaaagctatatgcttactggtaccagcagaagccaggccaggcccctagtcggtggtgagtatagtaaagaccgtagaggagcccgtacgacgggactccctggacgacgaactctacgtggcctcagtccgtacgacggggaaccaacgtacggtaccgtaacggtttacggacccgtaagtccgtaagggtacgggtaaccgtacccggtaaacggggtaccgtaaacgggtaaaccgggtaaacccgggaaccggggtaccgtttaaaccgggggtaacctttaaaaccggtttacccgtaaacccgggttttaacgtaacccgggttaaaaaacgttttaacggggaacccggttaaaccgggtaaacccgtaaaccgggtaaaccccggttaaaaaccggggttttaaaccccgggggtaaaaacccccgtttaaaaacccggggtttaaaccgggggggggttaaccccccggtttttaaagggggggttttttaaaccccggggggggggtttttaaccccggggggtttttttaaaaccccccgggggggggggttaaaaccgggggggggggtttttaaaaacccccccccgggggggggggggtaaaaaaccccccggggtttttaaaaaaaaaccccggggggggggtttaccccggggtttttaaaccccggggggtaaaccccccccgggggttttttaaaaacccccgggtttaaaacccgggggggttttaacccccggggttaaaacccccggggtttaaacccccccggggtttaaaaaccccccggggggggg

SEQ ID NO: 103163 - DNA, 554 bp, Homo sapiens
  misc_feature: GYAE6OF02G4FJW.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagccgtgagacggcctcgagggactcccgtagagcgaattctcgtcggctaccagcctacgaagggacaaacgagtacaacgtttcgacctatccgaggtcggactccgaggcaggaagacgaggctagactagcactgtacaaatgacagacagacaagtacggaacctaagtagggctggtaggttcggtacgggcgggaacgggaccaaggtccgtacggtaccgtaccgttaaggtaccgacggcccgtaacggg

SEQ ID NO: 103164 - DNA, 587 bp, Homo sapiens
  misc_feature: GYAE6OF02II4I0.3.34.D01.1.454.CMB.1.raw
  modified_base (303)..(303): a, c, t, g, unknown or other
  misc_feature (303)..(303): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagaccggcaggactcacctgctcgtggagatgctagttggacaaagctaatatgtcttacgtggtaccagacagaacgcgaggccacggtcccctggtcggtggtanatagtaagtaaacgaccgtgaggacgccctagaggactcctggacgacgaactctcgtggcctcgagtccgtacggaacgggaaccaacgtacggtaccgtaacggtttcgaaccctagtacgagggtacggaacgtccgaagggacaaggaacggacggaggactagtacctanaccatagaactaaangacaagacaagacaagaccgaaacagtgccgtggtcggtcggtcggacggaacgacgacgcgtacggaccgtactaacgtgaccgacgtaccgg

SEQ ID NO: 103165 - DNA, 635 bp, Homo sapiens
  misc_feature: GYAE6OF02JBLHY.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcagttggacaaagctatatgcttacgtaggtaccagcagagccgaggccacggccccgtgtggtggtgatataagtaaacggaccgtagacggacggcccgtacgagggtactcccgtgacgcgtaactcgtcgtcggcctccgagtcctacgacgggaaccaacgacggtacctaccggttcgaccatacgaaggtcggacgtccgaaggacgtaaggaacggtacggacggtcgtaagtaccgttaacgtcctaacgttacggtaactaaaagtacgacgaacgaacgaagactaaacgtacggaaaccgtaggtacgggtcgtaggttgggtcggtacggggacggaacggggaccaggtccgtacggtaccgtaccgtaacggtaccgaccggtcccgtaaccgg

SEQ ID NO: 103166 - DNA, 563 bp, Homo sapiens
  misc_feature: GYAE6OF02IA242.3.34.D01.1.454.CMB.1.raw
  modified_base (492)..(492): a, c, t, g, unknown or other
  misc_feature (492)..(492): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgcattggacaaagctatatgtcttactggtaccagcagaagccaggccacgccctgtggtggtgatagtataacgaccgtgagacggcctcgaggactccgtgagcgaatctcgtcggctccgagcgtacgagggaacctaacgacgtacgtacgtttacgacctagtcgtaaggtacgggacgtaccgaggacaagggaagacggaggacttgactactctacgtgtacaagtagacagacagacaagtacgaaccagtacggntaggtggtggttcgggacggacggtaccgacgtcgtacgtaccgtaccgtaacgtcaccggccgtaaccgg

SEQ ID NO: 103167 - DNA, 854 bp, Homo sapiens
  misc_feature: GYAE6OF02HJA09.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactgtaccagcagaagccaggcccaaggcccctggtcggtggtacagtaataagtaaaagacccgttagaacggtagggtcccctacgaaggggtacttaccccgttggaacgtcggaaaacttccgttaccgttagggccttaccgaagtccgttacgaaacggggaacctaaacgaggttacccaacgggttttacgaaccccgtaagttccgaaaggttacgggtaaacggttacccgaacgggtaaccgaagggtaaaaccgggtaaaccggtaaaggggacccgtttaaagggtaacccgtttaaacggttcccgtaaaacgttccgggttaaacccgtaaaaacgtttaaaccgggaccttaaaaccggaaaccgaaacggtaaccgtaaaaacgtttaccgggaaaaaacccccgttaaagggttaaccgggggttaacccgttagggtttacggggttaccgggtttttaaccggggaacccggggttaaacgggggaaaccccgtaaaggggtacccgtttaaccggggtaaacccccggtttaaccccgtttaaacggggttaaccccggttaaccgggaacccccgtaaaaccgggg

SEQ ID NO: 103168 - DNA, 545 bp, Homo sapiens
  misc_feature: GYAE6OF02GQHA8.3.34.D01.1.454.CMB.1.raw
  modified_base (480)..(480): a, c, t, g, unknown or other
  misc_feature (480)..(480): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaagccaggccaggcccctgtggtggtgatataataaagaccgtgagacggccctcgagggactcccgtgacgacgaatctcgtcggcctccagctcgagggacaacagtcacgttcaccatcgaggtcgacgtccgaggacaaggaacgacggaggtctacggtaactagtcacttagtacaaagtcgacagacagacaacgtacgaaccgagtacggntggtggtggtcgggacggacgggaccaggcgtacggtaccgtccgtaaggcacggaccgtaacgg

SEQ ID NO: 103169 - DNA, 707 bp, Homo sapiens
  misc_feature: GYAE6OF02ISDLY.3.34.D01.1.454.CMB.1.raw
  modified_base (356)..(356): a, c, t, g, unknown or other
  misc_feature (356)..(356): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctatatgtacttactggtaccagcaagaacgccgacggccacggcccctggtggtggtagaatataagtaaacggaccggtaggaacggtacggacccgtacggagggtacctccgnggaacggacgtaactcgtcgtcggaccttccgacgtcgtacggaacgggacctaaacgacggttaccgtacggtttacgaaccctaacgttacgtaacgggtgggtaaccgtacccggaagggaacgaagggaaacgtacggaggtaccgtagtaaccttacgtactacgtacgtaacaaagttacggacaacgtaacaagactaaacgtaaccggaaaccgtaaagtacgggtacgttagggttacgggtttacgggtaccgggtaaccgggggacgggtaaacccgtaacggtccgtaccggtacccggtttaccggaacgtacccggtaccggacccgtaacccgggg

SEQ ID NO: 103170 - DNA, 661 bp, Homo sapiens
  misc_feature: GYAE6OF02HG2LF.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggacaaagctatatgcttactggtaccagcagaacgccaggccacggcccctggtcggtggtgatagtaataaacggaccggtgaggacggtccctagacgggactcccgtgacgacgaactcgtcgtggccttaccgacgccgttacgaacggggaacctaaacgacgtaccgtacggtttacgaacctactacggtagtcgggtaacgtaccggaggtacaaagggaaaggtaaccgggaggtaccgttagtaaccgttacgtacctacgtagtaaccgaaagtacgtaccaagacgagaacaacgttaacgaaaccgtaggtacgggacgttggttacggttcgggttacggaccggggtacgggtaaccgtaacggcgttaccggtaacccgttacggtaacgtacccggacgtacccggtaacccgg

SEQ ID NO: 103171 - DNA, 692 bp, Homo sapiens
  misc_feature: GYAE6OF02JDTM3.3.34.D01.1.454.CMB.1.raw
  modified_base (298)..(298): a, c, t, g, unknown or other
  misc_feature (298)..(298): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatgcttacgtggtaccagcagaagccaggccaggcccctggtggtggtgatataanaaagaccgtggacggacggtccctagagggtactccccgtagagtcgaagttctcgtggacctccgagctcgaagggacctaacgacggtccgtacgtttacgacccaagtccgaggtacgggacgttacccgaacgggtaccaacgggaaaacggtaccggagggtaccgttaggaacctttaacgtacctacgtttacggtaccaaaaggttaccgaaccgtaacggaacacggtaacctaaaggttaccgggaaaaccccaggttacggggtaccttggggttaacgggtccgggttaccggggtaacgggaacggggtaacccctaaggtccggttaaccggtaaccccggtttaccgtaacggtacggtaacccgtacccggaaacggg

SEQ ID NO: 103172 - DNA, 718 bp, Homo sapiens
  misc_feature: GYAE6OF02JLBXQ.3.34.D01.1.454.CMB.1.raw
tcagagacgcactccacgaccggtgctcgatttagatcgtctgtgttgggtttgggggtgggtccgaggaggcagaactctgggtgtctcaccatggcctggatccctctacttctccccctcctcactctctgcacaggctctgaggcctcctatgagctgacacagccaccctcggtgtcagtcgtccccaggacagaccggccaggatccacctgctctggagatgcagttggacaaagctatactgcttacgtggtaccagcaagaacgcacggaccgaggcccccgtggtgggtggtgattagtaataaacggaccgtagagacggcccctacgagggactccccgtagacgcgaatcgtcgtaggcctccagctccggaaggaaccaaacgacggtacgtaccgtttacgaccgtatacgaaggttggaacggttacccgaggggtacaagggtaaacggaccggaggtaccgttagggaacccttagtaccgtaacgttcgtaacgtaaaagtacggaactaaggaaccaaggaacccgtaaacgttaacccgggaaaacccgtaacgggttaaacggggccttaggggtttacggggtttaccgggttccgggggtaaccgggaacgggggtaaacccgaaccggtacggtaccggtaaccccggttaaccgttaaacggtcccgaaccgggtacccccgtaaaccgggg

SEQ ID NO: 103173 - DNA, 643 bp, Homo sapiens
  misc_feature: GYAE6OF02IINIM.3.34.D01.1.454.CMB.1.raw
  modified_base (484)..(484): a, c, t, g, unknown or other
  misc_feature (484)..(484): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatccacctgctcgtggagatgctagttggacaaagctatagtcgtacttacgtaggtaccagacaagaacgccgacggccacggccccgtggtggtacgggtagtaagttaataaagtaaacggtaccggtaggtacggacggtccccgttacggagggtaacctcccgtagacgacgtaatccgtgttcggcctacgacgtctacggaagggaaccaacgtcgttaccgtacgttacgaacctagtaccgtaggttacggacgtacggacgganaaaggaacggacggtacgcgtagactactcgtactgaactaagagacgtacganacganaacgtacgaaccagtacgcgttggtggtcggtcgggaaccggagggtaacccgtagaccgttaccggaccgtaccgtaggtaccaccggtacgaacccgg

SEQ ID NO: 103174 - DNA, 658 bp, Homo sapiens
  misc_feature: GYAE6OF02GCRAB.3.34.D01.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctggagatgcattggcaaagctatangcttactcggtaccagcagaacgccgaggccacggcccctgtggtggtgatatanaaagaccgtgagacggccctagacgggtactccccgtagacgcgaatctcgtcggctacccgaactcgtacgggaactaccgacgccctactcgtacgacctagtaccgacggaccgggaccccgagggtaccttaagcgggtagtggaaccggtcttacgtaactttacgtttacgtgtaccgagggttcgggtcgggaaccgagggtccgggaccggacctaaccgttacccgtaaacgttacggttaccggggacggggacgggaacccgaggtccgtaaccggacccggttccgttaacgggccgaaccggtaccccgaagggccccgttacccggccccccggttacggtaccccg

SEQ ID NO: 103175 - DNA, 593 bp, Homo sapiens
  misc_feature: GYAE6OF02HP0TK.3.34.D01.1.454.CMB.1.raw
  modified_base (358)..(358): a, c, t, g, unknown or other
  misc_feature (358)..(358): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccctcggtgtcagtcgtccccaggacagacggccaggatcacctgctctggagatgcagttggacaaagctatatgtcttactggtaccagcaagaagccaggccacggcccctgtcggtggtgtatatataaagccgtgagacggccctgagggactccgtgagcgaactctactcggtctccgngctacgacgggaacaaacgacgtacctacgtttacgaacctataccgtaggtcgggagtaccgaggaccgaaggaacgacggtacggtctacgtacgtatccgtacgttcgtaccaaagtacgacagacagacaagtaccggaaaccagtacggcgtgggttaggtcggtcgggaccgggacggtaaccaagggtccgtacggtacccgtaccgtacgtccgacgcccgtaacgg

SEQ ID NO: 103176 - DNA, 735 bp, Homo sapiens
  misc_feature: GYAE6OF02JJ9YV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctcgtgggagatcgcagttcggacaaagtctatagtgtcttacgtcggtaccagacagaacgccacggaccgacggcccctggtcggtggtagtactaataagtaaacgaccggtaggacggacggtcccgtacgagggacttcccgagacgacgtaactcgttaccgtcggtcctaccgacgtaccgtacgaacgggaacctaaacgacgtaccgtacggttacgaccgtaacgtccgagggttacgggaacggtccgaaggtacgaaggtaaacggaccgagtaacgtacgtactaacgtaccagtacgtaacgtaaacgtcgaaccgaagaaccgaacgtaaccggtaacttaaacccggggaaacctaacgggtacgggttaccggttagggttaccggttacggggttaacccgggggagggtaaacccggggaacccgtaacgggtaccgttacccggtaacccgggtttaccggtaaagggttacccgaacggtacccccgggtaaccggg

SEQ ID NO: 103177 - DNA, 703 bp, Homo sapiens
  misc_feature: GYAE6OF02HYN75.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcacctgctcgtggagatgctagttggacaaagctatatgtcttactggtaccagacaagaacgccacggaccgacggtccccgtggtcgggtggttgaattaagtaagtaaaacggacccggttagaacggaccgggtccccttacggaacgggtactccccgtaggaacgtacggtaaacttccgttacgtcgggccttaccgaggtcctacggaacgggaacctaaacgtacgttccgtacggtttacgaacctagttaccgaaggtcgggtacgtacccgaagggtaccaaagggaacggtaacgggacggtacgttacggtaaccgtactaccgtaacgtagtaactaaagtacgaccgtaagaaccgaagaaccgtaagtaaccggaaacccaaggtacgggtacttcgggtggttacgggtcgggaacgggtacggaaccgacgtaccgtacggtacccgtaccgtaacggtcgaccgaccgtaccgg

SEQ ID NO: 103178 - DNA, 776 bp, Homo sapiens
  misc_feature: GYAE6OF02GT84R.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctctggagatgcagttggacaaagctatatgtcttacgtggtaccagcaagaacgaccacggccacggcccctggtgggtggtagattaagtaagtaaaggaccgtggaacggacgcccgtacgacgggactccccgtagacgacgtaagtcctcgtaggtccctccgaagtccgtacgaacgggtaacaacgtacggtaccgaacggtttcgaaccgtagtaccgtaggttacgggaacgttacccggagggtaccgaaaggaaaccgggaacccggtagggtacccgttaacggtaacttaaccggtacctaaccgttaggttaaaccctaaaagttaacgaccgtaaacggaaccgaaacggtaccggaaaaccgtttaacccgggaaaacccgttaagggtaaacggggtccggtttaggggttacggggttccgggtttaacccgggggaaccggggttaaaccggggacccgttaaccggggtccggttaacggtaacccgggttacccgtaaaccgggttaccgtaaccccgggtacccggttaacccggg

SEQ ID NO: 103179 - DNA, 768 bp, Homo sapiens
  misc_feature: GYAE6OF02IDV3F.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggactccacctgctcgtggagatcggctagttgggacaaagcttatagtgtcttacgtggtaccagcgaagaacgccgacggccgacggcccctggtggtcggtagaagttataaagtaaacggaccgttaggaggaccgggtaccctacggacggggtaccttccccgttggaacggtaccggaaacttcccgttcgtacgggtccctacccgacgtcgtaccggaacggggaaccaaacgtacgtaccgtaccggtttacgaaccctatacgtagggttacggacggtacccgaaggtacgaagggaaacggaacgggaggtacgtacgtaacttactaccgtaacgttacgtaaactaaacgtacgaacgtaacgaaccgacggtaacctaaacgtaacccgggaaaccgaaggttaacggggttcgtacggggttacgggtttacgggtttccggggaacggggtaacccggggtaacccgtaaacgggtcccgttaccggggtaacccgttaacccggttaaccggtaccgaaccccggtaccggtaaccccggg

SEQ ID NO: 103180 - DNA, 314 bp, Homo sapiens
  misc_feature: GYAE6OF02FSXH2.3.34.D01.1.454.CMB.1.raw
  modified_base (306)..(314): a, c, t, g, unknown or other
  misc_feature (306)..(314): n is a, c, g, or t
tcagagacgcactccacgaccggtgctcgatttagatcgtctgtgttgggtttggggtgaggtctgtgtcactgtggtattactatggttcggggagttaaagcagatgtttactactactactactacatggacgtctggggcaaagggaccacggtcaccgtctcctcagcctccaccaagggcccatcggtcttccccctggcaccctcctccaagagcacctctgggggcacagcggcctgggctgcctggtcaaggactacttccgagtgcgtctctgagcgggctggcaaggcgcatagnnnnnnnnn

SEQ ID NO: 103181 - DNA, 580 bp, Homo sapiens
  misc_feature: GYAE6OF02I9AMT.3.34.D01.1.454.CMB.1.raw
tcagagacgcactccacgaccggtgctcgatttagatcgtctgtgttgggtttgggggtgggtccaggaggcagaactctcgggtgtctcaccatggcctggatccctctacttctcccctcctcactctctgcacaggctctgaggcctcctatgagctgacacagccacccgtcggtgtcagtcgtccccaggacagacggccaggatcacctgctctggagatgctattggacaaagctatatgtcttacgtggtaccagcagacgccgaggcctacggcccctggtcggtggtgtatataagtaaagccgtagagacggcctcgagggactccgtagacgcgtaactcgtctggtcctacacgctacgacggacacgacgtcacgttcgactatcagtgacgtcgagcaaggagacgacgcgtagactatcgactgtacaatcgactagacgtagacgtaaagacggaaacccgagtaccggtcgtaggttcgggttaggtaccgggggacggaacgggtaccgaaggtccgtacggtaccgtacccgtaaggtcccaaccggtcccgtaaccggg

SEQ ID NO: 103182 - DNA, 679 bp, Homo sapiens
  misc_feature: GYAE6OF02GVIFE.3.34.D01.1.454.CMB.1.raw
  modified_base (181)..(181): a, c, t, g, unknown or other
  misc_feature (181)..(181): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgccaccctcggtntcagtcgtccccaggacagacggccaggactcacctgctcgtggagatgcagttcggacaaaagctaatatcgtactttacgtcggtaaccagacaagaacgccgacggcccgaccggtccccgttggtcgggttgggtacgtaattaacgtaaattaaaacggaccgtggaacggacgtcccgtacggagggccttcccgagacggacgtaactcgtcgtggcctccacgtctacggaggaacaacgtacgtactacggtacgacctagtcgaggtcggtaacgtccgaacggtacgaacgaaacgggcggaacgtcgtaacgaccttagtaccagtacgtaacgaaagttcgacgtacgaacgaacggtacaaacggtaccggaaaccagggttacggtacgtttcggtagggttccggggtaacgggaccgggtaaggaacccgaaggtccgacggtaccggttaccgaacggtaccgaccgtaccgtaaccggg

SEQ ID NO: 103183 - DNA, 725 bp, Homo sapiens
  misc_feature: GYAE6OF02I6P5O.3.34.D01.1.454.CMB.1.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
tcagagacgcactccacgaccggtgctcgatttagatcgtctgtgttgggtttgggggtgggtccaggaggcagaactcgtgggtgtctcaccatggcctggacttccctttacttcctccccctcctcactctctgcacaggctctgacggcctcctatcggagctgacacacgcccacccgtcggtgtacagtcgtccccgagggacaggaccggccaaggactccgactcgctcgtagganagtgctagttcgganaaagcttatagtgtcttagtcggacagacaagacgccgacggccgaccggcccgtggtcgggtaggagtaacgttaataacggtaaacgaaccgtgggaacggaccggtacccctaaggagggtaccctacccggtaggaacggtacggtaaccttcgtccgttacggcctaccgaagtcccgtacggaaccggtaacaaaccgtcgttaaccgacgttaacgactaacgtacgtaacgggttggaacgtaccgaggacgtaaacggaaggtaccggtaaggtcgtaaacggtaccttagtaacgtactaggttaacaaacgttacgacgaatacgaacgactaacgaccgtaacgacgtagggacgtggttacggtacgggttacgggaaccgggacggtaacggacgtaacggttccgtaacccggtcggtaaacgtacccggacggtaccgaacccggtcccg

SEQ ID NO: 103184 - DNA, 760 bp, Homo sapiens
  misc_feature: GYAE6OF02J2KEA.3.34.D01.1.454.CMB.1.raw
tcagagacgcactccacgaccggtgctcgatttagatcgtctgtgttgggtttgggggtggtccaggaggcagaactctgggtgtctcaccatggcctggatccctctacttcctccccctctcactctctgcacaggctctggacggcctcctagtgagtcctagacacacgtcccacccgtcggtctcgagttccgtaccccgaaggaccacggaccggccaggtactccgacctgtcctcgtagggatacgtcgacctagttacggacaaacgtctagtactcggtacttacgtacgacgacgacgaacggacgccgacggaccgtaccggccgttaggttcgggtagtataactaacgtaacgtaacggcgtacggacggcccgtaccgtacggtacgtaccgtccgtaggacgtaccgtactttccggtaccggtcggtacctaccgtacggtccgtaaggaaccggtaacctacgtacgttaccgtacgttacccgacgtacgtacggacggtacggtaccgtaccggaacggtacgaacggaacgtacggtacgtacgttaacgacgttacgacctacgtaccgtacgtaaacgcgtacgacgtaacgacgaacgttaaccgaacgtaccggtaacgggtacggtacggttacgggtacgggtttaccggaccggggaacggtaccggaaccgtacggtaccgtaccggttaccgtaccggttaccggtacggtacccggtaccggtacccgg

SEQ ID NO: 103185 - DNA, 687 bp, Homo sapiens
  misc_feature: GYAE6OF02HAYQ4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatccacctgactcgtggagatgctagttggacaaagtctatatcgtcttacgtggtaaccagacgaagaacgccgaggccacggtcccctaggtcggtggtagaattaagtaagtaaacgtaccggtgaacggacggtccctacgacgggactcccgaggacgacgtaaactccgttacgtggtaccttaccgagtcctacggaacggaacaacgtacggtacctacggtttacgacccgtaagtcgtaaggtacggacgtaccgagggacgtaaggaacggaacggacgtacgttacggtaacttacgtaccgacttagaacctaaagtacgactaacgacgaacgtaccgaaacgttaaccggaaacctaacggtacgggtacgttgggtacggttacggggtacgggacgggaacggtaacgacgtaccggtacggtacccgttacgtaaccggtaccgaccggaccggtaaccgg

SEQ ID NO: 103186 - DNA, 701 bp, Homo sapiens
  misc_feature: GYAE6OF02GASL5.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattggacaaagctatatgcttactggtaccagcagaacgccaggccacggcccctggtcggtggtgatataagtaaagaccgtaggagacggcctacgacgggactccccgtagacgacgtaactccgttacggtcggccttaccgacgtccgtaccggaacgggtaacaaaccgtacggtaccgtaaccggtttacgaaccctacgtaccgtaaggttacgggacgttaacccgaaggaccgaaacgggaaacggaaccgggtaaggtccgttaacgtaaccttaacgtaccctaacgttacgttaaacgaaaacgttacgaacgaacgtaacacggtaaccgtaacgtaaccgggaaccttaaacgggtcgggtaccgttggggttacgggttcgggttacgggggaccggtaacggggtaaccgacggtcgtacggtaccgtaccgttaacgccgtacgacccggtaccgg

SEQ ID NO: 103187 - DNA, 610 bp, Homo sapiens
  misc_feature: GYAE6OF02F56HC.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattggacaaagctaatatgcttactggtaccagcaagaacgccacggccacggcccctggtcggtggtagatataagtaaacgaccgtagaggacggccctcgagggactcccgtgacgcgaactcgtcgtggcctcgacgcctacgaacgggaccaaacgtacgtactacgttcgacctagtacgaggtaggacgtaccgacggcaacggaaagacggacggtctagaacttaactccgactacgtaacaaagtacgacaagacaacgacaacgtacggaacctaggtacggtacgttggtacggtgggttacggacggggtacggaaccgaacggtcgtaccggtaccgttaaccgtaacggccgtaccgacccgtaacgg

SEQ ID NO: 103188 - DNA, 610 bp, Homo sapiens
  misc_feature: GYAE6OF02JJJ3V.3.34.D01.1.454.CMB.1.raw
  modified_base (389)..(389): a, c, t, g, unknown or other
  misc_feature (389)..(389): n is a, c, g, or t
tcagagacgcactccacgaccggtgctcgatttagatcgtctgtgttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggagtcacctgctcgtggagatgcattggacaaagctatatgcttactggtaccagcagaacgccaggccaggcccctgtacggtggtagataagtataaagaccgtaggagtacggccctcgacgggactcccctaggacgacgaactctacgtaggcctacgagctacgacgggtaacaaacgngtaccacggtttcgaaccgtatccgagttacgggactccgaggacgagggaaacgaccgaggtactgaacgtactccgattacgaaccaaagtacaccgagacgacgactaacgccgaaacaacgtacgggaccttgggtacggttcggttaccgggacggtacgggaaccccaaggtcctacggtacccggtacctacggtaccgtaacggcccgaacgg

SEQ ID NO: 103189 - DNA, 550 bp, Homo sapiens
  misc_feature: GYAE6OF02IBCPV.3.34.D01.1.454.CMB.1.raw
  modified_base (222)..(222): a, c, t, g, unknown or other
  misc_feature (222)..(222): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagaccgccaggatcacctgctctgganatgcattggacaaagctatatgcttactggtaccagcagagccgaggccaggcccctgtggtggtgatatataagaccgtgagacgccctacgagggtactccgtgacgcgaatccgtcgtggcctccagtctcgagggacaacgacgtctacgtttcgaccagtacgagtggacgtcgaggacagaacggacgaggctagtactatacncgtagtacaanacgtacagacgagactaagtacgaaccgtagtacggcttggtaggttcggtcggacggacggtaacgacgtcgtcgaccgttcgtaacggtcgaccgccgtaaccgg

SEQ ID NO: 103190 - DNA, 681 bp, Homo sapiens
  misc_feature: GYAE6OF02FQ2TA.3.34.D01.1.454.CMB.1.raw
  modified_base (222)..(222): a, c, t, g, unknown or other
  misc_feature (222)..(222): n is a, c, g, or t
  modified_base (371)..(371): a, c, t, g, unknown or other
  misc_feature (371)..(371): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattggacaaagctatatgcttactggtacagcaagaacgccaggccacggcccctgtcggtggtgatatataaagacgtgagacggccctgacgggactccgtgacgacgaattctcgtggcctccgagctcgaacggacaacgngtacacgttcgacctagtacaggtaggacgtccgagggtacgaagtaaacggacgggacggacgtacggtaaccttaacgtacccgtaacgttacgtaaaccgaaacgttacggaacgtaacgaacgaaggaaccgtaaagtaaccggaaacccgtaacggtaacgggttacgttacgggttacggggtttaccgggttacggggtaaccggggtaaccggggtaacccgtaaacgggttcccgttacgggttaaccccggtttccgggtaccggggtttacgaaccccgggtaccccgaaacccggggg

SEQ ID NO: 103191 - DNA, 735 bp, Homo sapiens
  misc_feature: GYAE6OF02GWT1W.3.34.D01.1.454.CMB.1.raw
  modified_base (186)..(186): a, c, t, g, unknown or other
  misc_feature (186)..(186): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacgaggctctgaggcctcctagtgagctgacacgacgcccacccgtcggtntcagtccgtccccgaggacacggaccggccaggactaccgaccgtgcctacgtgggactagtcgactagttggaacctaaagtccttaatacgttcgtacgtttaccgtacggtaaccgagacgaacgtaaccggaccgacggtacccgaccggtcccgtagggttcggtcggtagtaagttaacgtaaacgtaaaccggtaccggtaggtacgggaccgtacccgtacggagggttacctacccggtaggacgtacgtaacttcgtacgtcgtcctacgacgtcgaccggtaacggaacaagtccgtaccgtacgtacaccgttcaacgtaggtacggaccgtacgacggaacgaacgggaacgacgggtagtacggtacgtaacttacgttacctacgtagtaaaccaagtaccgacaacggtcaacgaacgtaacgaaccgactaagggcgttacggtggttcggttacgggtcggaacgggtacgtaaccggtcgtacccggtaacggttaccgtaccgttacggaccgacggtacccgtaccgg

SEQ ID NO: 103192 - DNA, 648 bp, Homo sapiens
  misc_feature: GYAE6OF02JZN31.3.34.D01.1.454.CMB.1.raw
tcagagacgcactccacgaccggtgctcgatttagatcgtctgtgttgggtttgggggtgggtccaggaggcagaactctgggtgtctcacatggcctggatcctctacttctcccctcctcactctctgcacagctctgaggcctcctatgagctgacacacgccaccctcggtgtcagtgtccccaggaccagaccggccaggactccacctgcctcgtggagatgtacagttggacaaaaggctaactatgcttacgtgtaccagacagaacgccaggccgacggcccgtggtgggtacggatagtaagtaacgtaaaacggtccggttaggaggtaccggggtcccctacggacggggtaacctacccgtggacggtacgaaacttccgtcgtcggacttaccacggtcacggaaccggtaacacaccgggtactaaccgtaccgactacgtcgtaacgtgggtaacgtcgaacggacgaacggaacgaacgggcggctaacggactacgacctagttacgacttaaaagcgtacgaacgtacacgactaacgacgtaccgagacggtctaggtacgtcgggtcggaacgggtagaccgaacgtcgacggttacccgtagtaacggtaccacggtaccgaacgg

SEQ ID NO: 103193 - DNA, 742 bp, Homo sapiens
  misc_feature: GYAE6OF02HWUJ0.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgacggcctcctatgagctgacacacgccaccctcggtgtcagtgtccccaggacagacggccaggatcactgctctggagatgcattggacaaagctaatatgtacttacgtggtaccagcaagaacgccaggccacggcccctggtggtaggtagtattaagtaagtaaacggaccgtaggaacggacggtccctacggaagggtacttaccccgtaggtacgacgtaactccgtacgtcgggtacctaccgagtaccctacggaaggggtaaccaaacgtacggttaccgtaaccggtttaacggaaccctagtacgtaagggtacgggtaacgttacccggaagggaccaaagggaaacggaaacgggacggtaccgtacgtaaccgtactacgtacgttacggtaaactaaagtacggaacaaggaacacgacgtaaacgtaccggaaacccgtaaggtacggtacgttacgggttagggttcgggttaacggggaccggggaaaccggggtacccgtaaacgggtcccgtttaacccgggaacccggtttaaccgttaaccggtaaccgtaaccggtaccccggtaaacccggg

SEQ ID NO: 103194 - DNA, 790 bp, Homo sapiens
  misc_feature: GYAE6OF02G3PG0.3.34.D01.1.454.CMB.1.raw
  modified_base (226)..(226): a, c, t, g, unknown or other
  misc_feature (226)..(226): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctcgtggagntgctattggacaaagctatatgtcttacgtggtaccagtcaagaacgccgacggtccacggcccctggtggtcggtgatagtaagtaaacggaccgtaggacggacggccctacggagggtactcccgtaggacgacgtaacttcgtacgtcgggtacctaccgacgtacgttaccggaaggggtaaacccaaacgtaccggtaccgtaaccggtttacggtaaccctaagtaccgtaagggttacgggtaccggttaacccggaggaacgtaaacgggaaacggtacggtaacggggtacgtaacggtaaccgttaacgttacccgtaacgttacggtaaaccgtaaaacgttacgaaccgtaaacgtaaccgaagtaacccgttaaaagtaccgggaaaacccgttaagggtacggggtaccgtttacgggttacgggggttcgggttaacccggggtaaccggggtaaaccggggtaaccgtaaaccgggttcgtaacccgggttaaacccgggttaaccgttaaacgggacccggtaaccggaaccccggttaacccggg

SEQ ID NO: 103195 - DNA, 679 bp, Homo sapiens
  misc_feature: GYAE6OF02IKIR6.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagaccggccaggatcacctgctctggagatgctattggacaaagctatatgtcttactcggtaccagcagaacgccaggccgacggccctggtggtcggtgatataataaagccgtagaggacgcccgtagagggtactcccgtaggacgtacgaaacttccgtcgtcgggaccttccgagtcctacggaacgggaaccaaacgtacgtcgtaacgttcgaacctagtcgaaggtcgggacgtaccgaggacgtaaggaaacgggcgaaggtcgtagtaacttactaccacgttaacgtactaaaagtcgaacaagtaaaccgaacgaaccgtaaaagtacccgggaaacctaagggtaacgggtacttcgggttacgggttacgggttaccggggacggggaaccggggtaaacccacgggtaccggtaccggtaacccgttaacggtaaccggttacgaaccggtacccggtaacccggg

SEQ ID NO: 103196 - DNA, 750 bp, Homo sapiens
  misc_feature: GYAE6OF02JNBTU.3.34.D01.1.454.CMB.1.raw
  modified_base (240)..(240): a, c, t, g, unknown or other
  misc_feature (240)..(240): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacgaggctctgacggcctcctatgagctgacacacgcccacccgtcggtgtcgacgtcgtaccccgaggaccaggaccggccaggtataccacctgctcgtggganatgactagttcggacaagctatatgtacttacgtggtaccagacgaagaacgccgacggaccgaccgggtcccgtaggttcggggtacgggtacgtaagttaacgtaaaggtaaaccggtaccggtaggaaccgggtaccggtaccccgtacgggtaacgggtaccctacccggtaggacggtaccggtaacttccgtacggtcggtaccgttacccgacggtaccgtacggaaaccgggaacaaaccgtacggttacccggtaccgttaacgaaccgtacgtacggaacggttcgggaaccgtaccggaggacggaacggaaggaaccggtaggactacgtaactcgtacgtacgtagaacaagtacgacgagtaacgactaacgacgtaaccggaaccgtaaggtaggtacgttgggtacgggttacgggtaacgggacggtaaccggaaccgacggttaccgaccggtaccggtacgtaacggtaccgtaccggtaccggtaaccgg

SEQ ID NO: 103197 - DNA, 729 bp, Homo sapiens
  misc_feature: GYAE6OF02I8LQ8.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacagaccggccaggatccacctgctcgtggagatgctagttggacaaagctatatgtcttacgtcgtaccagcgaagacgaccgaggccgacggcccctggtggtggtagatagtaagtaaaggaccgtaggacggacggccctacgagggactccgtgacgacgtactcctacgtcgacctacacgtcgtacggacgggaaccgaaacgtacggtaccgtaacggtttacgaacccgtacgtacggaacggttaggggtaaccgtacccggtaacgggaacgaaacgggtaaacggaaccgggacgggtacgttacgtaaccgttaagaccttaacgttaacggtaaacaaaagtcggaaccaacggtaacgaaacggtaacaaacggtaaccggaaaccctaagggttacggggtcttaggggtcgggttacgggttaccgggaaccggggtaacgggtaaccggaccggtaccggtaaccgggtacccgttaaacgtacgggtacccgaccggacccggtaacccggg

SEQ ID NO: 103198 - DNA, 749 bp, Homo sapiens
  misc_feature: GYAE6OF02JF0QM.3.34.D01.1.454.CMB.1.raw
  modified_base (241)..(241): a, c, t, g, unknown or other
  misc_feature (241)..(241): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctggaggcctacctatgagctgaccacacgcccacccgtcggtgtcgagtcgtccccgaggaccagaccggccaaggactccaccgtgcctcgtagganatgctagttcggacaaacgtcttagtactgtacttacgtacggtaccagcgaagaacgccgaggcccgacggtccccgtggtcgggtaggtagtattaagtaagtaacgaccggtagaacggtaccggaccgtacggaacgggtacctccggacggacgtaccgtactccgtcgtacggcctacgacgtaccgtaggaacggaacctaacgtacgtacgtacgttacgaccagtacggtaggtaccggtaacgtaccgacggacgaaacggtaacggaaccggtgaccgttagaaccgttacgtacgaacccgttacgaacgtaagtaaccgtacgaaccggtacgaacgtaaccggaacgtaccgggtaaccgtagttacgggtccggttagggtaccgggtacgggttaccgggaaccgggtaaccggggtaacgtccgggtaccgttaacccgggtaaccggttaccggtaaccggtccccgggtaacgacccccggtaaccggg

SEQ ID NO: 103199 - DNA, 596 bp, Homo sapiens
  misc_feature: GYAE6OF02F1LET.3.34.D01.1.454.CMB.1.raw
  modified_base (460)..(460): a, c, t, g, unknown or other
  misc_feature (460)..(460): n is a, c, g, or t
tcagagacgcactccacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagcccaccctcggtgtcagtgtccccaggacagacggccaggatcacctgctctggagatgcagttggacaaagctaatatgtacttactcggtaccagacagaacgccaggccacggcccctggtggtggtgatagtaagtaaacggaccgtaggagacggacccgtcgacgggactcccgagacgacgtaatctcgtcgcctccgagtctcgaaggaaccaacgagtcgtaacgttgacctaagtcgaggtacggacgtaccgagacgaaggaagacggaggctagactacncactgacaatagacagaacagtacaagtaccggaactagtacgggcttagggtcggttacgggtcgggacgggaacgggaacccaggtaccgtacggtaccgttaaccgtaaggtcccgaacggccccgtaacggg

SEQ ID NO: 103200 - DNA, 765 bp, Homo sapiens
  misc_feature: GYAE6OF02HKURC.3.34.D01.1.454.CMB.1.raw
tcagagacgcactccacgaccggtgctcgatttagatcgtctgtgttgggtttgggggtgggtccaggaggcagaactctgggtgtctcaccatggctggatccctctacttctcccctcctcactctctgcacaggctctgaggcctcctatgagctgacacacgcccacccgtcggtgtcgagtcgtccccaggacacggacggccaggactcacctgcctcgtagggagtacgtcgactagttacggacaaacgctaatagtcgtacttacgtcggtaaccgagtacgaacggacgccgacggaccgtaccggcccgttaggtgggtggtacgaattaacgtaagtaaacggaccggtaggacggacggtccctacgggtaacggaccgttccgtggaacgtacgtaacgtccgtcgtacggcctaccgtagcgttaacggaacgaactaaaccgtacgtacccgtacggttacgaaccgtcgtaacggaacgggttacggaccggtacgacggaaccgaaagggaaccgtaagggacgtacgttagtaacttaccgtaacaccgttaagaaaccgttaagtaccggaacgaacgaacgtaagaaccgttaaacggaacccggtaaccgtaaggtacgggttaccgttggggtttacgggtacgggttacccgggggacggtaacgggtaaccgtaaccggcgtttacccggggtaacccgttacgtaaccggtacccgaaccggttacccggtaacccggg

SEQ ID NO: 103201 - DNA, 773 bp, Homo sapiens
  misc_feature: GYAE6OF02HXNX6.3.34.D01.1.454.CMB.1.raw
  modified_base (168)..(168): a, c, t, g, unknown or other
  misc_feature (168)..(168): n is a, c, g, or t
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
  modified_base (456)..(456): a, c, t, g, unknown or other
  misc_feature (456)..(456): n is a, c, g, or t
  modified_base (625)..(625): a, c, t, g, unknown or other
  misc_feature (625)..(625): n is a, c, g, or t
tcagagacgcactccacgaccggtgctcgatttagatcgtctgtgttgggtttgggggtgggtccaggaggcagaactctgggtgtctcacatggcctggatccctctacttctccccctcctcactctctgcacaggtctctggaggcctcctatgagctgacaacncgccacccgtggtntcagtcgtccccaggacacggacggaccagganccacgtcgtctgaggagatgcgtagttcggaactaaacgtctaagtactggtacctttagtacggttaaccagacgaaaacggacgacccgaacgggaccgtcccggaccccggttaggtccggggttggttaacgtaaagtttagtaaaaggtaaaaccgggtaacccggtaggaccggtaccggtacccctagggaacgggtacctacccgagaggtacctaagtctcgtacgccgaanacgtcgtacgaaacgggtaactaaccgacgtaccgtgttaaccgacctaagtcggtaaggtacccgtaagtacccgaagggaccgtaaagaccggaacgttaaacgggctaccgtaaacgtacgttaaccgacgttaaagtaccgaaagttacgaacggaagtaacgtnaaacgtaaacggtaccggaaaccaaacgggttgggtaacttacgggttcgggtaacgggtcccggggtaagggtaacccgggaacgtaaccgtaccggttaggacccgtttaaccggaaacgtacgttacccggaacccgtaacccgg

SEQ ID NO: 103202 - DNA, 685 bp, Homo sapiens
  misc_feature: GYAE6OF02HI8OV.3.34.D01.1.454.CMB.1.raw
  modified_base (220)..(220): a, c, t, g, unknown or other
  misc_feature (220)..(220): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgagcctcctatgagctgacacagccaccctcggtgtcagtcgtcccaggacagacggcaggatcacctgctctgganatgcattggacaaagctatatgcttactggtaccagcaagaacgccaggccacggccccgtggtggtggtgattataataaacggaccgtgaacgacggtaccctcgaacgggactcccgtagacgacgtaaatccgtcgtcggacctaccgaagtccgttacggaacgggaaccaaacgtacgtacctaacgggtttacaacccgtaagtacctaagggtagggtaaccgtaccgaacgggtacgaaacggaaacggtaacggaacgggtcgttaacgtaaccttaacgttaccgaacgttaccggtaaacgtaaaacgttacgaacgaacggtaacgacgaactaaagtacgaaacttaccgagttacggtgttcggtgggttacggtccgggaacgggtacgggaaccgtaaggtaccgtacgtaaccggttaccgtaacggtaccgtaaccggtaacccgg

SEQ ID NO: 103203 - DNA, 685 bp, Homo sapiens
  misc_feature: GYAE6OF02JHFQ8.3.34.D01.1.454.CMB.1.raw
  modified_base (285)..(285): a, c, t, g, unknown or other
  misc_feature (285)..(285): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgaccacacgcccacccgtcggtgtcaggtcctccccaaggacagaccggccaaggactccaacctgactcgtaggagatgcaagttggaccaaagctatactgcttactgtacagcaggaaaccngggccccaaggcccctaggtacccggttcgtagggtacgtagtaacgttaaagtaacgtaaaggaaccggtacgggaccgtacggaccggtactaccgggtagtacccgtcggtaacgtccggtaactacggtcgtacgacgtcctacgacgtacgaacggacgtaacgaacgtcgaaccgtacgtaccacgtcgacgtacggacggtacgaaggaacgacgaaggaccgtaggacgtacgtacgtacttacgactagtacgaactaacgacaagacgaagacgaacgtacggaaccgtacgtacggtacgtacggttacgggtacgggtacgggaaccggtaacggtaccgtacggaccgttacggaaccggttaccgtaacggtaccgaacggacccg

SEQ ID NO: 103204 - DNA, 727 bp, Homo sapiens
  misc_feature: GYAE6OF02JPBE3.3.34.D01.1.454.CMB.1.raw
  modified_base (136)..(136): a, c, t, g, unknown or other
  misc_feature (136)..(136): n is a, c, g, or t
  modified_base (561)..(561): a, c, t, g, unknown or other
  misc_feature (561)..(561): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcanaggctctgaggcctcctatgagctgacacagccacccgtcggtgtcagtcgtccccaggacagacggccaggactccaccgtgcctcgtggacgatgctagttcggactaaaaggcttaatagttcgtacgttaacgttcgggttaaccacggacaacggaacgccgaacggcccgaccgggtcccccgttggttcgggttgggtagtaagttaacgttaaagtaaaacggtacccgttggaaaccggaccggtccccgtaggtaaggggtaccttaccccgtggaaacggtccgtaaagttccgttaccggtcggtcccgtaacgccggactacggagggaaccctaaacggtcgttaccgtacggtttacgacgttacttcggaagtcgggacggtccaagggtactaaggaaggtaaccggnggtaccgttagtacgttagtactaacgttgtaacgtaaataggacctagaactacggaacgtaacgaacgtaaacctagggacgttgtacggttggtacggttccgggacggaggtaacccgagtccgtacgtaccggtacgtacggtctacccggaccgtaccgg

SEQ ID NO: 103205 - DNA, 717 bp, Homo sapiens
  misc_feature: GYAE6OF02H5CE2.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccctctcactctctgcacaggctctgaggcctcctatgagctagacacagcccacccgttggtgtcagtcgtccccaggacaggacggccaggatcacctgctcgtggagtatgctagttggacaaagctatatgtcttacgtaggtaccagacaagaacgccgacggccgaccggccctggtgggtggtagattaataagtaaacgaccggtaggacggacggtcccgtacgacgggtactacccgtaggacgtacgtaactccgttacgtggcctaccgacgtcgtacgacgggaactaacgtacgtaccgacggtttaccgaacctaacgtcgtacggtacgggtaacgtaccgaggaacgaaggaaacggtacggacggtacctacgtaacgttacgtaccgtaacgtagtaaaccgaaagttaacggaacgtacgaacgtacggaacgtaaacgtaacccgggaaacccgtaggtaacgggtacttacgggttacgggttaccgggtcggggaacgggtaaccgggaaccggttaacggacggttacggaacccggttaccgttaacggtaccggtacccgtacccgtaacccggg

SEQ ID NO: 103206 - DNA, 743 bp, Homo sapiens
  misc_feature: GYAE6OF02HBLNW.3.34.D01.1.454.CMB.1.raw
  modified_base (91)..(91): a, c, t, g, unknown or other
  misc_feature (91)..(91): n is a, c, g, or t
tcagagacgcactccacgaccggtgctcgattttagatcgtctgtgttgggtttgggggtgggtcctaggaggcagaactctgggtgtctnaccaatggcctggatccctctacttcctcccctcctacactctctagcacgaggctctgacggcctctatgtagctgaccacagcccacccgtcggtgtactagtcgtaccccgagggaccaggaccggcctaggactccacctgcttcgtggagtatgctagttggactaaagtctatagtcgtacctttacgtcggtacctagaccaaggaacgccgacggacccgacggtcccccgtggttacggtgggtagtaacgttataacgtaaacggaccggtaggacggtacggtcccctacggagggtacctccccgtagacggtacgtaacttcgtcgtcggcctacgtacggtctacggacggaacaacgtacgtcgaccgtttacgaactactacgtaggtacggacgtacccgaaggactaaacggaaggtaacgacgggtaccgttacgtaacgttacgttactaacggttctaaacgtaagtaacgacgtaacgtaaccgacgtaaccaaacgttaccggaaaccctaaggttaacgggcgttagggttacggttacgggtaaccgggacgggtaaccggaaccgtaacggttccgacggttaacccgtaccgttaaacggtacccgacggtaacccgtaacccgg

SEQ ID NO: 103207 - DNA, 751 bp, Homo sapiens
  misc_feature: GYAE6OF02HUFVB.3.34.D01.1.454.CMB.1.raw
  modified_base (611)..(611): a, c, t, g, unknown or other
  misc_feature (611)..(611): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgcacaggctctgacggccctcctatgagctagacacacgcccacccgtcggtgtccagtccgtccccgaaggaccacggaccggaccgaaggtactccaccgtcgcctgtagggaagtagtcgacgtaagttacggaacctaaaagtctaattacgtaggtaccttacgtacggtaaccgagacgaaggaacgccgaacggcccgacggtcccggtaggtggtcggtagtaattaagtaacgtaaacggtaccggtaggaacggaccggtcccctacggaagggtacctccgaggacggtaacgtaacttccgtacgtcggtacctaccgacgcgtaaccggaaggaaccaacgacgtacctaaggtaccgtaacacgttcgagggtacgtacaccggaggacgaagggtaaagacggacgtacgtaaacgtactacgtacgtaaccgtagttaaaccaaggtacgacaaccggtanaaccgtacgtaaagttacccggaaacgtaggacggtacgttacgggtccgggtttagggaccgggtaaaccgggacggtaaaccgtacgcgttaacccggaccggttaactacgggtacacccgggtaccgtaacccggg

SEQ ID NO: 103208 - DNA, 762 bp, Homo sapiens
  misc_feature: GYAE6OF02HVBRT.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattggacaaagctatatgcttactggtaaccagcaagaagccaaggccacggcccctggtcggtggtgataataagtaaacgaccgtggaagacggccctacgacgggtactccccgtaggacgtacgaaattccgtcgtcgggcctaccgaagcctacggaacgggaaccaaacgtacggtacctaacggtttacgaacctaagtaccgtaagggtcgggtaacgtacccgaagggaccgaagggaaaacgacgggaacggtacgtaacggtaacctaacgttaccgtaacgttacggtaaaccgtaaaaacgttacggaaccgaacgaaaccgaaacggtaacccgtaaaacgttaacccggggaaaacccctaaacggggttaacggggtcccggtttagggttacggggtttacgggttaacccgggggtaccgggggaaaccggggtaaaccccgaaacggtccggttaccgggaaccccgtttaaccggtaaaccggtttaccgaacccgggaaccccgtaacccgggg

SEQ ID NO: 103209 - DNA, 960 bp, Homo sapiens
  misc_feature: GYAE6OF02F5S90.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtcgtcagtcgtaccccaggacagaccggccaggactccacctgccttcgtggacgtatggactagtttcggaccgaaaagtcctaattctagtacctttacgtacggttaaccgaacgtaccgaacgaaacggaccgtaacgggacccgaaccgggtcccccgttgggttacgggttcgggtacgtaagttaagttaaaccgttaaaacggtacccgggtaaggtaaccggaccggtaccccgtaacggacgggtaaccttccccggtaagaacggaccgtaaacgttcgttacggtcggtccctacccggaacgtcgttaccggaaacgggaaccctaaacgtaccggtaaccggtacccggttaacggtaaccctacggtaaccgtaaggggttacggtaaccgggtacccggtaacggggtaaaccgaaacggggtaaaccggtaaaccgggaggttaccggttaacgggtaaacctttaaccggtaccgtaaccgttaacggtaaacgttaaaacgtaaccggaacgaacggtaaaccgaaacgggtaaccttaaaaccgggtaaacccggttaaaaccggtaacgggttaacgggtaccgggttttacggggttacgggggttttaacccgggttacggggggggaaccccggggttaaaccggggtaaacccggttaaccgggtaacccggggtttacccggttaaccccggggttttaacccggtaaacccgggttttaccggaaaccccggtaccccgggtttaacccccgggg

SEQ ID NO: 103210 - DNA, 765 bp, Homo sapiens
  misc_feature: GYAE6OF02GNYKW.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccagacagacgcaggatcactgctctggagatgctagttaggacaaagtcttaatagtcgtacttacgtacggttaaccaggtacaacggaacgaccgacgggacccgaaccggtccccgttggttcggggttacggtacgtaattaagttaaacgtaaaacggtacccggttaggaacgacgggtccctacggaagggtaccttcccgtaggaaccgtaccgtaaattccgttcgtacggtcctaccgtacgttacggaacgggaacctaacgtacgtactaacggttacaacctagtacgaaggtacggtaagtacccgaggacgtaaagaacggacggtaggacgtacggaacttagtaccgtacgttacgtaaactaaacggacgtacaaacgtacgaagtaaccgtaaacgtaccggaaacccgtaaaggttaaccgggacgttacgggttcggttaacgggttaccggggaccggggtaaacgggtaacccgtaacggttaccgtttaaccggaaccgtttaaccggttaaacggtacccggtaaaccggtaccccggaaggttcccccgg

SEQ ID NO: 103211 - DNA, 797 bp, Homo sapiens
  misc_feature: GYAE6OF02JF2V1.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacagctctgacggcctacctagtgacgctgacacgacgcccacccgtcgggtgtcaggtccgtaccccgaggaccgaggaccggaccaggtactaccgtaccctggccttcgtagggagtacgttcgactaggttacggaactaaacgtcttataacgttcgtaccgtttacgtacggtaccacgacgaaaggaaccgaccgaccggaccgtaccggtcccccgttgggttacgggttcggtagtaataagttaacgtaaacggtcggtacgacggtaccggtcccgtacggacgggtaccgtccggtaggaacgacgttacttcgtccgtacgtccctacgacgtaccgttacggaaacggtaaccgtaacgaacggttaccgttaccggtacgaaccctaagttaccggtaaggttaccgggtaacggtacccggaacggtaacgaagggaacggtacgggaacggttcttacgtacttagtaccgtacgtactaacgtaacgtacgaaccgaacgtaagacgaactaacgggtaaccgaaccgttaggtacggtacggttacggttgggtaccggttacgggaaccgggtacggaacccgtacggttaccggtaccggttacccgtacggttaccggtaccgacccgaccggtaacccgg

SEQ ID NO: 103212 - DNA, 611 bp, Homo sapiens
  misc_feature: GYAE6OF02FG4WP.3.34.D01.1.454.CMB.1.raw
  modified_base (462)..(462): a, c, t, g, unknown or other
  misc_feature (462)..(462): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggaccagaccggcaggatcaccgtgcctctggagatgctagttggacaaagtctatagtcgtaccttactcggtaccagacaaggaacgccgacggccgacggcccctggtcgggtggtgtataataagtaaacgccggtggagacggccctgaggctccctagagacgaatcgtcgtgcctccgagtctcggaagggaacaactcgctacgtacgacatcgaaggtgacgtaccgaggaccgaaggaacggacgagcgttagacttacnctacgttagtaacaaagtgaccgtaagacgaagtactaaacgtaccggaaacctaggtacgggtacttgggtacggtcgggttacgggacggacgggtaaccaaggttcgtaccgtaaccgtaccgttaagccgtacgacccgaaccgg

SEQ ID NO: 103213 - DNA, 829 bp, Homo sapiens
  misc_feature: GYAE6OF02G1DWU.3.34.D01.1.454.CMB.1.raw
tcagagacgcactccacgaccggtgctcgatttagatcgtctgtgttgggtttgggggtgggtccgaggaggcagaactctgggtgtctcaccatggcctggactccctctacttctccccctcctcactctctgcacaggctctgacgcctcctatgacgctgacacagccaccctcggtgtcagttccgccccaggacagaccggccaggactccacctgcctcgtggagatgctaagttgacaaagtctatagtcgtacttacgtcggtaaccaggtacgaacggaacggaccgacgggaccgtaaccggtccccgttagggttcgggttagggttagtaacgtttaagtaaacgttaaaaacggaccgggtttaacggaacggaaccgggtacccgttacggaacggggtaactccccggttaaggaacggtaaccgtaaacgtcgtccggttacggtacctaccgtacgaccgtacgaaagggaacccgtaactaggtaccgttaacggtacgaaccgtagacggtagacgggtacgtaccgtaggacgaaggtaacgggaaccggacggttacaacggtaaccctagtaacctacggttactaacgaaaacgttcggaaaccgaacgtaaccgtaagggaccgttaaacggtaacccgaaaaccggtttaacggaaacgggttccgttacgggttcgggttttaaaccggggtccgggtaaccggggggaaaccggtaaacccgttaacgggtaccggtaacccgtttaccccgggttaacggtaaacccggtttaccggacccggtacccgggaaacccggg

SEQ ID NO: 103214 - DNA, 595 bp, Homo sapiens
  misc_feature: GYAE6OF02I6UC4.3.34.D01.1.454.CMB.1.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctatatgtcttactggtaccagcaagaagccgaggccacggcccctgtggtggtgatatataaacgaccgtgagacgcctgaggactcccgngagacgaatctcgngctccanctcgaggaacaacgagtcacgttcgacctagtacgaggtaggacaccgaggacgaacggtaaacggaccgtagggctacgtactagtacctaacgtagtactaaagtcgactacgaacacggactaaacggtacgaaaccaaggtacggtcgtaggttgggtacggttcgggacgggtaacggaaccgacgtacggtaccgaacccggttaccgtaaggtcccgaacggtacccgtaaccggg

SEQ ID NO: 103215 - DNA, 715 bp, Homo sapiens
  misc_feature: GYAE6OF02I550V.3.34.D01.1.454.CMB.1.raw
  modified_base (135)..(135): a, c, t, g, unknown or other
  misc_feature (135)..(135): n is a, c, g, or t
  modified_base (552)..(552): a, c, t, g, unknown or other
  misc_feature (552)..(552): n is a, c, g, or t
tcagagacgcactccacgaccggtgctcgatttagatcgtctgtgttgggtttgggggtgggtccaggaggcagaactctgggtgtctcaccatggcctggatccctctacttctccccctctcactctctgcanggctctgacggcctctatgagctgaccacagcccacccgttggtgtcagtcgtcccaaggaccagaccggccaggatccacgtgctcgtaggtagatgcgtaagttcggaacaaagtcttaatcgttcgtcgttaactcggtacctagacgtaaggaacgaccggacgtacccgtaccggtcccgttagggttgggtacggttagtaacttaagttaaacgtaacggtaccgaggacggaccggtccgttaggacggtcctaccggtagaccgtactcgtacgtcgtcgcctcacgctaacggacgtaacacgtacttcgacggttacactatcgtaggtcggcgacggaaggcaaaggacgtacggtacgtaccgtagaaccttcgtaccgttaacgtcgtaaaccaagtacccgntaacggacgttaacgacgtaaaccgtaacggtaccgtaagggtgtagttccggtttaggtaccgggttacggggaacccgggttaaagacccgtttaaacgggtccggtttaaaccgtcccggttaaacccggttaggtaccccggacggtaacccgtcccgg

SEQ ID NO: 103216 - DNA, 684 bp, Homo sapiens
  misc_feature: GYAE6OF02JG00T.3.34.D01.1.454.CMB.1.raw
  modified_base (251)..(251): a, c, t, g, unknown or other
  misc_feature (251)..(251): n is a, c, g, or t
tcagagacgcactccacgaccggtgctcgatttagatcgtctgtgttgggtttgggggtgggtccaggaggcagaactctgggtgtctcaccatggcctggatccctctacttctcccctctcactctctgcacaggctctgacgcctctatgagctgacacagccacctcggtgtacagtcgtccccaggacagacggtcaggatcacctgctctaggatactgactagttcggacaaagtctatacgtntacgttacgtacggtaccagcgtaagacgaccgacggtaccgaccggtcccgtggtacggtggtagtactaacgtaagtaaacggtaccggtaggaacggaccggtaccctaggaacggtctacccgtagacgtcgtaaacgttctccgtacgtcctacgacgtccgtaaggacggaacctaacgtacgtaccgttacgttacgacgtacgttacgacggttacggacgttaccgagtacgaaacgaggaacggtacgtacgtacgtaaaccttcgaccgttacgtaacgtaacgaaacttacggaacaacggaaccgaacgtaacgtaacgtaaccggaacccgtttaagtcggttaccggtaggttccgggtagggtacccgggaggtacgacgtaagcgtacgtaccgtaccgtagctacggacctacgg

SEQ ID NO: 103217 - DNA, 804 bp, Homo sapiens
  misc_feature: GYAE6OF02GPU8P.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactccactgctcgtggagtatgctagttggaccaaagtctaatacgtcgtccttacgtcggtaccagcgaaggaacgccgacggcccgacggtcccccgttggttcgggtcgggtagtagttaataacggtaaaacggtaccggtaggtaacggaccggtcccgtacggacgggtacgtccccgtaggacggtacgtaacgtccgttacgtcggtacctaccgacgtccgtacggtaacggggaacctaaacggtacggttaccgttaccggttacgtaacccgtacgttaaccggtaggttaacgggtaacccgttacccggaacggggtaaccgaaagggtaaacgggaacccggtagggtaacgttacgtaacgttaacgtaccctaacgttacgtaaacaaacgttacggaaccaaacgggtaccgaagtaaccgaacgttaaccgaaacccgtaggttaccgggacgttgggtacgggtttacgggaccggggtaacgggtaaaccgggtaccgtaaccgggtaccggtaccggtaaccccggtttaaccgtaaccggttacccggaacccggtacccggtaaacccggg

SEQ ID NO: 103218 - DNA, 745 bp, Homo sapiens
  misc_feature: GYAE6OF02H3PZA.3.34.D01.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacagctctgaggcctcctatgagctagacacacgccaccctggtgtcagtcgccccgaggacgagacggccaggatccgactgctcgtgganatgctagtgganaaagctatntgcttactggtaccagcagacgccgaggccgacgcccgtggtggtggtgaacgtagtaagtaaaaggtccgtaggaacgggaccggtccccgtacggaacggggcttaccccgagggaacggtaccgttaaaccgcccgttcggttaggtccccgttaccgaggtacccggtaccgggaaaggaaacccgtaaaccgtaggttacccgtaaccggtttaacgtaccctagtaaccgtaccgggtaagggtaaccgtccggaaggtacggaaggaaacggacggtaacggtaccgtaggttaaccgacttaacccgtagtacgtaaaccgaaaagttacgaaccgtaaacgacctaacggtaacctaacggttacccggaaacccgtaggtacgggtacgtagggttcgggttacgggttacggacccggggtaagggaacgtacgacccggttacggtaacccgtacggttaaccgtacgacccggaccctaaccgggg

SEQ ID NO: 103219 - DNA, 649 bp, Homo sapiens
  misc_feature: GYAE6OF02FLCAZ.3.34.D01.1.454.CMB.1.raw
  modified_base (255)..(255): a, c, t, g, unknown or other
  misc_feature (255)..(255): n is a, c, g, or t
  modified_base (510)..(510): a, c, t, g, unknown or other
  misc_feature (510)..(510): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatcactgctctggagatgctagttcggacaagctatatgtacttacncggtaccagcaagaacgccgaggccgacggtcccgtggtcggttaggtagaataagttaagtaaaacggaccggtagaaggaccgccctacggaacgggtacctcccgtagacgacgtaacgttcctcgtcggcctcgagcgtacgaacgggaacaaacgtagtacgtaacgttacgacctagtacgtagggtcggaacgtaccgaggaacgaaggtaacggaacggaggtactacgacgttacgactaacgtanaaccaaatcggacagtacaacgaccgtaacgacgaaaccgtaagtacgggacgttaggtgggttaccggtcgggacggtaacggaaccaggtccgtacgttaacccggtaccgttaaggacctacggacccgtaaccgg

SEQ ID NO: 103220 - DNA, 714 bp, Homo sapiens
  misc_feature: GYAE6OF02GMRIX.3.34.D01.1.454.CMB.1.raw
  modified_base (223)..(223): a, c, t, g, unknown or other
  misc_feature (223)..(223): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattggacaaagctatatgtcttacgtcggtaccagacagaacgccgacggccgacggcccctggtcgggtggtcgtattataaagtaaacggtacccggtaggaacggacggtcccctacggaacggggtacttccccgtaggaacggacgtaactccgttcgtcggaccttcccgaaggtccgttacggaacggggaactaaaccgacggttaccgtaccggtttacggaaccctagtacccgtaggtacgggtacgtaccgaacgggtacgaacggaaacgggaaccggtacggacgttaacgaacgttaacgttacctacgttacgtaacgaaacgtaggacaagacaacgtacaacgttaacggaaaccctaggtacgggtcttagggttcggtttacgggtaccggggaacgggacgggtaacccgaggtaccgtaccggtaaccggttacccgtaacggtcgaccggtaccgtaacccggg

SEQ ID NO: 103221 - DNA, 807 bp, Homo sapiens
  misc_feature: GYAE6OF02HP02N.3.34.D01.1.454.CMB.1.raw
  modified_base (643)..(643): a, c, t, g, unknown or other
  misc_feature (643)..(643): n is a, c, g, or t
tcagagacgcactccacgaccggtgctcgatttagatcgtctgtgttgggtttgggggtgggtccaggaggcagaactctgggtgtctcgccatggcctggatccctctacttctccccctcctcactctctgcacaggctctgaggcctcctatgagctgacacagccacccgtcggtgtcagtcgtccccaggacaggaccggccaggatccaccgtgctcgtaggagactgctagttcggacaaaggtactagtactcgtaccttacggtacgtaaccgagtacgaacggaaccgacgaaccggacccggtaaccggtccccgtttagggttacggggttaggtacgtaaagttaaacgttaaaacggtaaaaccgggtacccggtagggaaccggtacccgggtacccgttacggggaaaccggttacccgttacccggtaagggaaccgtaaacgtaaccgttccgttacgttaccggcccgtaccgtaaccgttacgtaccgggaaacgtaaccgtaacgtacgtacggttacgtaccgaacctaggtaccggtaggtcggtaacgtcgggaacgaacgtaacggacggaacggtacggacttaacgtacttcgtacctaacgtacgtaaacgtaanacgtacgtaacgaaccgagtaacaaccggttaacccggaacgtaaggtcggttaaggtcggggttacggttcggggtaaccgggacggggtaaaccgtacggtaaccgtcggttaacccggacccgttaaggttacccgaacgtcccggtaaaccggtacccgg

SEQ ID NO: 103222 - DNA, 866 bp, Homo sapiens
  misc_feature: GYAE6OF02H4YZM.3.34.D01.1.454.CMB.1.raw
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctggtntcagtcgtcccaggacagacggccaggatccacctgctcgtagganatgcagttggaccaaagctaatatgtccttacgtacggtaccagacaaggaacgcccgacgggacccgacgggtccccccgttgggttacggggttagggtacgtaagttaagttaaacggttaaaaaccggaacccggttagggaaaccggtaccggtacccccgtacgggaacggggtacctccccgtacggacggtaccggtaaacttccgttaccgtacgggtaccttccgaacggtaccgtaaccgaaacggggaaccaaacgtacggttaccgtaaccggtttaccggaacctaacgttacccgtaagggttacggggtaacggttacccggaaacgggaccgtaaacgggaaacgggtaacccgggaagggttaaccgtaacgggtaaccgttaagttaaccccgtaacggtttaccggtaaaccgtaaaggttacgaacccgtaaacgggaaccgaacgggtaaccaaacgggttaacccgggaaacccgtaaagggtttaccggggaaccgtttcggggttacgggttaccgggtttaccggggggaaccggggtaaacggggtaaccggtaacggtaccggttaccggtaccgggttacccgtaacggtacccgaccgacccggtaacccgg

SEQ ID NO: 103223 - DNA, 763 bp, Homo sapiens
  misc_feature: GYAE6OF02H84CX.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctctcactctctgcacaggctctgacggccttacctatgagctagacacacgcccacccgttggtgtcaggttccgtaccccgaggacgacggaccggccaaggactccaccgtcgtccttacggtagggagtactgacaggttacggaactaaagtacttaagtacgtcggttacttacgtcggtaaccagacgaagaccgacgacggaccgaccggcccgttggtcggtagtagtaataacgtaaagtaaacggtaccgtagaacgggtccgacccgtaggacgggtacctccgtaggacggtactaaccgttccgtacgcggtaccctaccgtaacgggtaccttaacgggacggaaacctaagttaccgtaccgtaacgttaccgaacgtacgtacggtacggacggtaccgtacggaaggacgtaaggaacggtaggacgtcgtaacgtacttactaccgtaagtacgtaacgaaagttacgaacgtagaaccgtaacgaacgtaacgtaccggaaacgtaacggtacggtagtcgggttacgggtacggtacgggggaccggtaacggtaccggaacgttccggtaacggtacccggtaaccggttacggtaaccggtaaccgacccggtaacccggg

SEQ ID NO: 103224 - DNA, 662 bp, Homo sapiens
  misc_feature: GYAE6OF02FQS3Z.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctggagcctcctatgagctgacacacgcccacccgtcggtgtcagtcgccccgaggacagaccggccaggatccacctgctcgtgggacgagtcgctagttcggacaaagtctatagtcgtacttacgtacggtacacgacaagaacgccgacgggccacggtccccgtggttcggtagggtgtaagttaagtaacgttaaacggaccggtggaacggtaccggcccgtacggaacggggtacctcccgtaggacggacgtaacgttcgtcgtcggacctccgagcgtacgaagggaccaacgagtaccgtacgttaccgacactcgacggtggtacgtacgaggacgagaacgacggagcgtaagactacgtcgatacgtaacgaagtacgacgtaacgactacgacgaaaccggtccgaaaccgtaaggtccggttagttacggtcgggtacggttcgggcgggaacggtaccgaggtaccgtacggtaccgtacgtacgaccggaccgtaccgaccgg

SEQ ID NO: 103225 - DNA, 764 bp, Homo sapiens
  misc_feature: GYAE6OF02HO0N5.3.34.D01.1.454.CMB.1.raw
  modified_base (237)..(237): a, c, t, g, unknown or other
  misc_feature (237)..(237): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccacccgtcggtgtcgagtcgtccccgaggacacggacggccaggtactccaccgtgctcgtggagntgactagttacggacaaagtctaagtatcgtaccttacgtacggtaaccacgtacgaaggtaacgccgaacgggacccgtaccgggtcccccgttagggttcgggttcgggttaagtagttaacgttaaacggtaaacggtaccggtaggaaggaccggtccctacggacggtaccgttccgtaggtacgacgtaaactcccgttacgtcggtaccttaccgacgtccgtaacgggaacgggaaacctaacgtacgttaccgtaacggttaccgaaccgttacgtacgtaacgggtacgggtacccgtaccggaaggtacgtaaacggaacggacgggacggtacgtacgtaactacgtacgaacgttcaaacgtaacgtacgacgtaacgaacctaggaactaacggtaaccggaaactagggtacggtcgtagggttacggtaccgggttacgggacgggtaacggaacgtacggtcccgtacggtacccgaacgttacggaaccgtaccggaccgtaacccggg

SEQ ID NO: 103226 - DNA, 647 bp, Homo sapiens
  misc_feature: GYAE6OF02HFZDQ.3.34.D01.1.454.CMB.1.raw
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
  modified_base (538)..(538): a, c, t, g, unknown or other
  misc_feature (538)..(538): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccacccgtcggtgtcagtcgtccccaggacagacggcaggatcacctgctctggagatgcattggacaaagctatatcgtacttacgtggacctagcaagaacgcgagccacggccctgtggtggngatataagtaagccgtaggacgacgtcccaggacggactcccgtgacggcaattcncgtcgcctacgagcctacggacggtaaccaacgtacgtccgtaacgtttacgaccgtactacgtacgggttacggaccgtaccgagggtacaaagggaacgacggacgtcgtaagtaaccgttataaccgagttacgaacaaatagacgaagaaccagaccgtaaacgtaccgaaacctagggtacggngttaggttcgggtacgtaacgggggaccgggtaaacgggtaaccttaacgggtaccgttaaccggttaccgttacggtacccggaacggtacccggaaggttaccccgg

SEQ ID NO: 103227 - DNA, 933 bp, Homo sapiens
  misc_feature: GYAE6OF02JGSFR.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcttcacttctctgcacgaggtctctgacggtccttacctagtgacgtcgtacaccaacgaccgacccctacccggttcgggttcgtacgtacggttacccgtacccccgaagggaccgacggacccgggaccgtaaggacctaccgtacccgttgtccgttacgggtagggaacgtacgtcggtaccgttaaggttacgggaaaccaaaggtacttaattaacggttacgttaccggtttaacgttacgggtaaacccgagtaccgaaaacggaaccgaccgggtaaccgaccccggaccggttccccgttgggttggggttaggtaagtaattaagttaaaacgtaaaccgggaccgggtagaaccgggtacccgtcccgtaacgggaacgggtaccccttaccggtagggaaccggttacgtaccgtttctaccggcggtcccctacgtacggaccgtaacgggaaaccggtaacctaaacggtaccggtacccgttaaccggtacaacccgtaagtaccggtaagggtacgggtaccggtacgacggaacgaagggaacggacggtacggtaccgtaacggtaaccgtacgtaacctacgttaacgtaaactaaacggtacgaacgaacggtaagaccgggtaaactaaccggtaacccggtaaacggtacggttacggggttaccgttagggttaccggggtaccgggtttaacggggacggggttaaacggaacggtacccggttacggtaacccgggtaaccggttaccgtaaccgggtaccgacccggtacccgggttaacccgg

SEQ ID NO: 103228 - DNA, 817 bp, Homo sapiens
  misc_feature: GYAE6OF02HQ5Q0.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgagcctctatgagctgacacagcccacccgtcggtgtcagtcgtccccgaggacagaccggccaggatccacctgctagtggagatcgctagttcgggacctaaagtcttaattagtcgtacctttaacgtacggtaacccagacgaacggtaacgccgaggcccgaccgggtccccctagggttgggtggtgtaacttaagtaaagtaaacggccggtaggaacggaccggtccccgtacggaacgggtacccttacccgtaggacgacgtaacttccgtaccgtcggtccctaccgacggtcctacggaacgggaaccaaacgtacgttccgtaacgtttccggaacctacgttcgggaaggttacgggacgtacccgggacggtaacgaaccggtaaagggtacccggagggaaccgttacgtaaaccgttaccttccggaaacccgttaaggtaacctaaacgggtaccacggtaaaccgaaaccggtaccgtaaacgtaaaccgcccgggtaaaacccgaagggtttaccgggtgtaccgggtttagggttacccggggtaacggggtacccgggggaaacggttaacccgaacgggttacccgtaccggggtaaccccggtttaaccgaccggttaaacccggacccggttaccccggtaaacccggg

SEQ ID NO: 103229 - DNA, 801 bp, Homo sapiens
  misc_feature: GYAE6OF02H9LQ8.3.34.D01.1.454.CMB.1.raw
  modified_base (309)..(309): a, c, t, g, unknown or other
  misc_feature (309)..(309): n is a, c, g, or t
  modified_base (525)..(525): a, c, t, g, unknown or other
  misc_feature (525)..(525): n is a, c, g, or t
tcagagacgcactccacgaccggtgctcgatttagatcgtctgtgttgggtttgggggtgggtccaggaggcagaactctgggtgtctcaccatggcctggatccctctacttctccccctccctcactctctgcacaggctctgaggcctcctatgagctgacacagccaccctcggtgtcagtcgtccccaggacagaaccggccgaggatcacctgctctggagatgcagttggacaaagctagtatgtcttacgtaggtaccagcaacgaagccgtaacggcccgacggcccccggttggttggngggttagaattaagttaagtaaaaccggtaccgtaggaaggaccggtacccgtacggaacgggtcctcccgtagacgtaccggaattccctcgtcggtccgtaccgacgtacgtacggaacgggaaacccgtaacgtaccgtaaccggttacccgggttaacgtaacccgtaacgtaacgttaacgggtgggtaacccggtaccggaaacgggtanaaacggggaaacggtaaccgggaacggtcggtaaaccgtagttaaccgtaccgttaacccggttaagtaaaccgtaaacgttaggaaccccgaagaaaccgacgaacccgtaaaacgttacccgggaaaccgaaaccggttaacgggggcttaacggggttgggtacgggtaacccggggtacggggaacccgggttaacccggtaacgccgggttaaccggtaccccggttaaacggtacccgttacccggaaccggccccggttaaaccccggg

SEQ ID NO: 103230 - DNA, 646 bp, Homo sapiens
  misc_feature: GYAE6OF02HGQMX.3.34.D01.1.454.CMB.1.raw
  modified_base (225)..(225): a, c, t, g, unknown or other
  misc_feature (225)..(225): n is a, c, g, or t
  modified_base (374)..(374): a, c, t, g, unknown or other
  misc_feature (374)..(374): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgccacctcggtgtcagtcgtccccaggacaggacggccaggactcacctgctctgganatgctagttcggacaaagtctatatgcttacgtcggtaccagcaggaacgaccgacggccacgggccccgtggtcgggtggtgataataataaacggccgtagaggacgcctcgaggctcccgtgagacgaattcctcgtggccttacnggctcggaggtaacaacgtagtccgtacgttacgactatcgtaggtacggacgtcgaggacgacggaaggaccgacggtactacgacttacgtaccgtacgtacgtaaccaaagtacgtaccgaagtaacgtacgaaccgtaacggtaccggaaacccaggtaacggcgttgggttacgggtacgggttccgggacggggtaacccggaacggacggttaccgtccggtaacccgttacggtaacggtacccgaccggttacccgaaccggg

SEQ ID NO: 103231 - DNA, 745 bp, Homo sapiens
  misc_feature: GYAE6OF02F34K6.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcagttggacaaagctaatatgtacttacgtcggtaccagacaagaacgccacggccacggtcccctggtggtggtagatataagtaaacggccgtagagacggccctagagggtactcccgagacgacgtaactcgtcgtcggcctaccgagtcctacggaacgggtaacctaaacgacggttaccgtaccggtttacgaaccctagttaaccggaacggtacgggtaaccgtaccggaagggtaccgaaacgggtaaacgggaaccgggtacgggtacgttaacggtaaccgttaacgtaccgtaacgttcggtaaacgaaagttaccgaacgtaacggtaaccgtaacgtaaccgtaaacgttacccggaaacccgtaagggttacggggtaccgtttaggggttcggggttacgggtaccgggggaaccggggtaaccggggtaaccgtaacggtccggtaccggttacccggttaacccggtaacggttacccggaacggtaccccggtaaccgg

SEQ ID NO: 103232 - DNA, 669 bp, Homo sapiens
  misc_feature: GYAE6OF02HKU6Z.3.34.D01.1.454.CMB.1.raw
  modified_base (225)..(225): a, c, t, g, unknown or other
  misc_feature (225)..(225): n is a, c, g, or t
tcagagacgcactccacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagaccggccaggatcacctgctctggganatgctagttggacaaagctatatgcttactggtaccagcagaacgccacggccacggcccctggttggtggtgatataataaacggtaccgtaggacggacggtccctacgagggactccccgtaggagacgaatctcgtaggtcctccgagtctacgaagggaaccaactacggtaccgtaccgttacgaaccctacgtacgaggtgggaaccgttaccgaaacgacgaaacggaaacgacggaggcgttacgaacttacgtacctaacgttcgtaactaaacgtaagaccgaagaacgaacgaacctaaagtaaccgggaaaccctaggtaacgggtccgttaggttcggggttacgggttccggggaacggggtaacgggaaccgtaacggccgttacggtacccgtaccgtaacggtacccgacgaccccgtaacccggg

SEQ ID NO: 103233 - DNA, 788 bp, Homo sapiens
  misc_feature: GYAE6OF02GKNX9.3.34.D01.1.454.CMB.1.raw
  modified_base (234)..(234): a, c, t, g, unknown or other
  misc_feature (234)..(234): n is a, c, g, or t
  modified_base (491)..(491): a, c, t, g, unknown or other
  misc_feature (491)..(491): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcctacccgtcggtgtcagtcgtccccgaaggacagacggccgaggactccacctgcttcgtgggagntcgcagttcggacaaagtctagtatgtaccttacgtacggtaaccagacgaagaacgccgacggaccgaccggccccgttgttcgggtggtagaattaagtaagtaaaccggacggtaggaacggtacggcccgttacggaggtacctcccgtaggacgacgtaactcgtcgtacggcctacgacgtcgtcggaaggtaaccgaacgtacggtactaacggtacaaccgtagtacggtagggtcggtacgtaccggngacgaaggaacggtacgggacggtagtacgtaacttacgtacgtaacgtcgtaaacgtaacgtacgaacgttaacgaaacgtaacgtaacgtaacggtaaacccggtaaccgttaaacgggtacgggttacccggttaggggtttaccgggtaccgggggttttcccgggggaggggttaaaccccggggaaaaccggtttaccggtaacccgggtttaaaccgggtaaccccggttttaaacccggtaaccggtaccccgggtaaaccccgggtaccccggttaaaacccccgggg

SEQ ID NO: 103234 - DNA, 710 bp, Homo sapiens
  misc_feature: GYAE6OF02FMN4B.3.34.D01.1.454.CMB.1.raw
  modified_base (230)..(230): a, c, t, g, unknown or other
  misc_feature (230)..(230): n is a, c, g, or t
tcagagacgcactccacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctgacacacgcccacccgtggtagtcagtcgtccccgaggacagaccggcaggatccacctgctcgtgganatcgactattcggacaagtctatagtgtaccttcgtacggtaaccagacaggaacacccggaggacccaccgggccccttggtacgggtggtagaacttaacgtaacgtaaaacggaccggtaggaagggacggtcccctacggtaacgggtacctacccgtagaacggtaccgtaagtccgttcggtacggtccctaccgacgtacctggtaaccgggtaacaaaccgtaggtacctaccgggtaacgacctacgtacggtacggtagggaaccgttccggaggaaccgaaggtaaacggacgacggtcgtacgaacttactaccgactacggtactaaaggcgaactaacggaacctacgaacctaaggtacccggtaaacctagggtaccgttgtacgggtacggttagggtaccgggaagtacggggaaccctggtacgtaaccgtccgtaacggtacgacgtcgaacccggtacg

SEQ ID NO: 103235 - DNA, 736 bp, Homo sapiens
  misc_feature: GYAE6OF02H2LGP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctcccccctcctcactctctgcacaggctctggaggcctcctatgagctgacacacgcccaccctcggtgtcagtcgtccccaggacaggaccggccaggactcacctgctcgtggagatgctagttcggacaaagctatatgtacttacgtcggtaccagacgtaaggacgaccgacggccgaaccggtccccgtggtggtgggttacgaattaagttaaacgtaaacggtaccggtaggaacggaccggtcccgtacggaagggtacctcccgtaggacgacgtaactccgtcgtcgtacctccgacgtcgtaccggaacgggaaccaacgtcgttaccgtacggtttaacgaccctagtacgtaggtcgggtacgtaccgaaggtaccgaaggaacggaccggtaggactacgtaacttacgtacctaacggtactaaacgtaaacgtcggaacgtaacggaaaccgtagaaccgttaacgtaacgggaacccgtaaggttacgggcgtttagggttcgggttacgggtaaccggggacgggtaacgggaaccgtacggtaccggttaccggtaccggttaccgtaaccggttaccgaacccggtacccggtaacccggg

SEQ ID NO: 103236 - DNA, 649 bp, Homo sapiens
  misc_feature: GYAE6OF02HQX7S.3.34.D01.1.454.CMB.1.raw
  modified_base (139)..(139): a, c, t, g, unknown or other
  misc_feature (139)..(139): n is a, c, g, or t
  modified_base (176)..(176): a, c, t, g, unknown or other
  misc_feature (176)..(176): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (536)..(536): a, c, t, g, unknown or other
  misc_feature (536)..(536): n is a, c, g, or t
  modified_base (549)..(549): a, c, t, g, unknown or other
  misc_feature (549)..(549): n is a, c, g, or t
  modified_base (559)..(559): a, c, t, g, unknown or other
  misc_feature (559)..(559): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
  modified_base (598)..(598): a, c, t, g, unknown or other
  misc_feature (598)..(598): n is a, c, g, or t
tcagagacgcactccacgaccggtgctcgatttagatcgtctgtgttggggtttgggggtgggtccaggaggcagaactctgggtgtctcaccatggcctggactccctctacttcctccccctctcactctctgcacnggtctcgtgacggcctactagtggagcctaggaaccncacggtcccacccgttgggtatccgaaggttccggaccccaagggacacggtaaccggccaagggtacttcccgaacgttcgcttccggngggacgtctggacctaggttaggacaaaggtccttaatnttcggtacttaccgtagtaccganacgagtacgccgaggtaccacggcccttgggttaggtggtataacttactaaggaaacgccgtaggacggacggtaccctagggacgtactccgtgacggtactatcgtcgcgacctaccgagccgtaacgacggtaacaacgacgttcgaacgtttcaccgagtcgaggtcggacgcgaggtcgaaagngtacgnggtcagtacancgattacataagngactagacgnacgttaggaccagacggngcgtttagngggttacccggnggaaccgggtagccacgtacggcaaccgttcgaacggcaccggactcccgg

SEQ ID NO: 103237 - DNA, 735 bp, Homo sapiens
  misc_feature: GYAE6OF02JN49T.3.34.D01.1.454.CMB.1.raw
  modified_base (221)..(221): a, c, t, g, unknown or other
  misc_feature (221)..(221): n is a, c, g, or t
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgacggcctctatgagctgacacagcccacccgttcggtgtcacggtccgtccccaggacacggacggccgacggtanccacctgctcgtagggatagtcgctagttggaccaaagtctatagtcgtcttaactcggtaccagcaagaacgcgacggccaccggcctaggtggcggtgactaattagaagccgtgacgcgcctaggagcctccgagacggacacttcgngttcggccttcgagtacgacggaaggaacctaaacgngtccctaacgggttacaccgtaactcggtaacggtgggtaaccgtaccggaggtaacgaaacggaaacgggtaccgggtacggtacggtacgtaacccgttaacgtaccgttacgacgtaaaacgtaaccgtaacggaaccaaaccgtacgaacgtaaccgtaaaccgttaaccgggaaacccgttaaaggtccggggttaaaccgttgggttcggtttaccggggtttaaggggaacccgggtaaggtaacccggaaccggtaaccgttaccggggtaacctaccgggtttaaaccgacccggtacccggtacccggtaacccgg

SEQ ID NO: 103238 - DNA, 707 bp, Homo sapiens
  misc_feature: GYAE6OF02GOWBE.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctctatgagctgacacagccctaccctcggtgtcagtcgtaccccaggacaggaccggccgaaggactccaccgtgcctcgtaggagatcgctagttcggacaaagctatatcgtcttacgtacggtacgacgacgaagaacgccgacggaccacggtccccgttgggtcgggtaggtagaacgttaagtaacgtaaacggtaccggtaggacggaccggtcccgtacggagggtacctcccggtgacggacgtaacttcgtacgtggacctacgacgtcgtacggaacgggaacctaaacggtacggtaccgtaaccggttacgaaccgtacgtacggtagggtacgggtaaccgtcggtaagggacaaacgggtaacggaaccgggtaggtctacggtaactacgtacctaacgtacgtaaactaacgtaacgactaacgaactacgacgtaaaccgtacggaaccctaaggtacgtcggttaggtacgggtcggtacgggacgggtaacggaccgtaacgtcgacggtacgtaccgaacgccgaccgtaccgaccg

SEQ ID NO: 103239 - DNA, 682 bp, Homo sapiens
  misc_feature: GYAE6OF02JE894.3.34.D01.1.454.CMB.1.raw
  modified_base (182)..(182): a, c, t, g, unknown or other
  misc_feature (182)..(182): n is a, c, g, or t
  modified_base (335)..(335): a, c, t, g, unknown or other
  misc_feature (335)..(335): n is a, c, g, or t
tcagagacgcactccacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacacgcccaccctcggtntcagtcgtccccaggacacgcggccaggactcacctgctcgtgagtatcgctagttggacaaagtcttatagtcgtacttacgtcggtaaccagacgaagaacgcccgtacggaccgtaccggtccccgttggtagggtcggtagtaacttanaacgttaaaacggccgtaggacgtacggcccgtagacgggtctacccgtggacgcgtaactctacggtcgcctacgcgcgtacggaaggtaccaacgacgttccgtacgtacgaccgtctacgtaaggttcgggaacgtaccgaggtacgaaacgggtaagaccgggtagtacgtacgtaacgtacgtacgaccgttagtaaacaaacgtcgaaccgagaacgaacaacgtaacgtaaccggaactaaggtacgggtacttagggtcggtacgggtcgggacgggaacggtaaccagtccggtaccggtaccgttaacgtacggtaccgaccgtaccggtaacccgg

SEQ ID NO: 103240 - DNA, 813 bp, Homo sapiens
  misc_feature: GYAE6OF02IPHZS.3.34.D01.1.454.CMB.1.raw
  modified_base (183)..(183): a, c, t, g, unknown or other
  misc_feature (183)..(183): n is a, c, g, or t
  modified_base (235)..(235): a, c, t, g, unknown or other
  misc_feature (235)..(235): n is a, c, g, or t
tcagagacgcactccacgaccggtgctcgatttagatcgtctgtgttgggtttgggggtgggtccaggaggcagaactctgggtgtctcaccatggcctggatccctctacttctcccccctcctcactctctgcacaggctctgaggcctcctatgagctcgacacagccctacccgtggtntacagtcctacccgaggacacggaccggcagctccgactggcctcgtagganactcgctagttcggaactaagtctagtacgtcgtaccttacgtacggtaccgtagacgaacgaaccgtaccgacggaccaccgggtcccgttagggtcgggtaggtaacgtataacgtacgtaaacggtaccggtagtaacggaccggtacctacggaacgggtaccttcccggaggtaaccgtacgaacgttccgttaccggtaccgtcccgtacgaccgtaccggtacgaagggaacctaaccggtacgtacccgttacggtaccgtaacgacgttacgaacggtacggtacgtacccggtaagacggtaaacggaccggacgtacccgaacgttacggtaccgtaactaccgttaaacgtacggtaacgtaacgttaccaacggaaccttaaccgggaactaacggtaaacggtaacccggtaacggttaacggtacggggttacccggtttagggaccgggtttaccggggaccgggtaaacccggggtacggtaaccccttaacggggtacctttacccgggaaccggtttaaacccgacgggaaacccgtcccggtaaacggtaaccccggg

SEQ ID NO: 103241 - DNA, 695 bp, Homo sapiens
  misc_feature: GYAE6OF02FSUWN.3.34.D01.1.454.CMB.1.raw
  modified_base (89)..(89): a, c, t, g, unknown or other
  misc_feature (89)..(89): n is a, c, g, or t
tcagagacgcactccacgaccggtgctcgatttagatcgtctgtgttgggtttgggggtgggtccaggaggcagaactctgggtgtctnaccatggcctggatccctctacttctccccctcctcactctctgcacaggctctgaggcctcctatgagctgacactacgcccacccgtcggtgtcagtcgtacccccgaggaccagaccggccaagggactccaacctggcctcgtggaagtatcgacattggacaaagctatactgtcttacgtacgtaccacgtcaagaacgccgacggcccgacggcccccgttaggtgggttcggtagacttattaaggtaaacgtaccggtaggtagacggccctacggaggtactcccgtagacgaccgtaacgtactcgtcggtaccttccgacgtccgttaacgacggggaacctaacgtaggtaccgtaacggtcgaccgtactaccgaggttcggacgtaccgacggacacggtaacggacggacgttacgagtacgtaacgtccgtactcgtaacgtaacaacggactaacgacgtaagacgtaagtaaccggaaccttacggagggttccgttaggtcggtacgggttccgacgggtaaccgggtaacgacggtaccgtaccggtaccgttacgttaaccgaccggtaccaaccggtacccgg

SEQ ID NO: 103242 - DNA, 771 bp, Homo sapiens
  misc_feature: GYAE6OF02HGH57.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctctatgagctgacacagcccacccgtggtgtcagtcgtccccgaggacaggaccggaccaggactcacctgctcgtggacgatcgactagttcgggactaaacgtcttaattagtcgtactttaccgtggtaacctagaccgtaaggaacggccacgggcccgaacgggtccccgtagggttgggtgggtacgtaagtaataagtaaacggaccgttaggacggtaccggcccttacggacgggacctccggtagacggtacggtaactccgttcgtcggacctccgacgtcgtacggacggaacacgtacggtaccgtacggttacgaacctagttcgtagggtacggtaccggtacggacggcgtaaagggaaccggacgggtacggacgtacggtaactacgttaccgtaacgtacgtaacttaaaggaccgtacgtaacggaactaacggtaacctaaccgaaaccgggtaaacccgttaagggtacgggttaccgggttaggggttacggggtttacggggttacccggggggacggggtaacgggaacccggtacgggtaccgttaccgggaacccggtttacgttaaccggccggtaccggacccggtacccggg

SEQ ID NO: 103243 - DNA, 657 bp, Homo sapiens
  misc_feature: GYAE6OF02GVW98.3.34.D01.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (574)..(574): a, c, t, g, unknown or other
  misc_feature (574)..(574): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagaccggcgaggactccacctgcctcgtaggagatgctagttcggacaaagtactattagtcgacttacgtcggtaccagacgtaagaacgccgacggccgacggcccctggtggtggtagatataagtaacgaccggtaggacgcggcctacggagggtacctcccgtagacgcgtaactcgtacgtcggtccnccgngcgtaggacgggtaaccagaccgttacgtacggtacaccgtacgtcgtacgggtacggtaccgtaccgacgggtacgaacggtaacggacgtacggcggttaacgtactacgtcctaacgttagaacctaaacgtagacaagacgtagacgaacgtaaccggaaccaggtacgggtntcgggttcggtacggtccgggacggtaaccggaacggtacgcgtacggtaccgttagtaacccgcggtacccgcggtaaccgg

SEQ ID NO: 103244 - DNA, 775 bp, Homo sapiens
  misc_feature: GYAE6OF02HM2MD.3.34.D01.1.454.CMB.1.raw
tcagagacgcactccacgaccggtgctcgatttagatcgtctgtgttgggtttgggggtgggtccaggaggcagaactctgggtgtctcaccatggcctggatcctctacttcctcccctctcactctctgcacaggctctgacggcctcctatgacgctgacacgacgcccacccgtggtctcgagtccgaccccgaggacgacggaccggcgaaggactccaccgttgctcgtaggacgtatcggactagttcggaactaaagtacttatacgttcgcctttaacggtcggtaaccaggacgaacggaaccggccgaacgggtcccgtaccggtccccgttagggttacgggtacggttagtaattaacgttaaacggtaaaccggtccggtaacggacgggtaaccccgggtcccttacggggaacgggtccttacccggtagggaacggttacctaacgttcggtacgtcgggtaccttacgacgaccgttacggaacggtaaccaacgtcggtaccgtaacggttacaaccgtagaccggtaggcgggttaacgacggaggtaaccgaaaggacggtacggacggtacttacggtaacttacgtacgaacgtacgtaaacgtaagtacgaccgaagaacgtacgaacgtaacgtaaccggtactaacgggtcgttagtcggggttaacgtcgggttaacgggacgggaacgtacccggtaagtccggtaacggacccggttaacgaacggttccgacggacggtacccgg

SEQ ID NO: 103245 - DNA, 777 bp, Homo sapiens
  misc_feature: GYAE6OF02F2SX4.3.34.D01.1.454.CMB.1.raw
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagatgacacacgccacccgtcggtgtcagtcgtccccgaggacagaccggccaggatcacctgctcgtggagatgctagttggacaagctagtatntacttacgngtaccagtacaagaacgccgacggaccgacggccccgtggttcggtggtacgaagtattaagtaaacggaccgtaggaacgacgggtcccgtacggagggtacctaccgtaggacgacgtaacttccgtcgtccgcttccaacgtcgtacggaacgggaacctaacggaacgtaccgtaaccgtttacgaccgtacgtaccggtaggttacggtaccggttacccggaagggtaccgaaacggtaacggtacggaacggtacgtacgaaccgtttaacgtaacccgtacgttaccgaaacgttaaacgtacgtaaccgaacgtaaccgtaaaggtaccgtaaaacgtaaccggtaaaccgttacgggtaacgggttccgttaggggtttcggtacccggggttacggggtaaccggggaacccgggttaacccggaaccggtttaacccgggtaccggttaaacccgggtttaccgtaaccggtaccgttaaccccggacccggttaaccccgggg

SEQ ID NO: 103246 - DNA, 747 bp, Homo sapiens
  misc_feature: GYAE6OF02HOTAG.3.34.D01.1.454.CMB.1.raw
  modified_base (136)..(136): a, c, t, g, unknown or other
  misc_feature (136)..(136): n is a, c, g, or t
  modified_base (180)..(180): a, c, t, g, unknown or other
  misc_feature (180)..(180): n is a, c, g, or t
  modified_base (570)..(570): a, c, t, g, unknown or other
  misc_feature (570)..(570): n is a, c, g, or t
  modified_base (590)..(590): a, c, t, g, unknown or other
  misc_feature (590)..(590): n is a, c, g, or t
  modified_base (642)..(642): a, c, t, g, unknown or other
  misc_feature (642)..(642): n is a, c, g, or t
tcagagacgcactccacgaccggtgctcgatttagatcgtctgtgttgggtttgggggtgggtccaggaggcagaactctgggtgtctcaccatggcctggatccctctacttcctccccctctcactctctgcanaggctctgacgtcctctatgagctagacacacgccaccgtggtntcagtccgtcccgaggacacggaccggacaggtacctccaccgtgtcctacgtagggaactagtcgctaagttacggaactaaagtctaagtacgtcgtaccttacggtcgtaaccagtacgaagaaccgcggaaccggtaccgtaccggtcccggttaggtacgggttaggtaacgtaacttaaagtaaacgtaaaacggtccgtaaggacggtaccgtccgtaggtacgtacctcgtaggacgtacgtaacgtcgtacgtcgtaccgaccgtacgtacgtaacggtaacgaacctaacgtacggtacccgttaaacggtcgtaaaccgtacgttccgaagggtttaaccgacgtacgtaacggacgtaaacggacggcggtaacggtntacgtaacttcgaccgttanaaccgtaacgtaaagtcgacgaacgagtaacgaacgtaacggaccgaaacgngggttacgcggttaggttacggtaccggggtaaccggaggtaacccggtggaaccgttaccggttacgaaccggttcgtaaccgaccggtaccgtcgttacccgg

SEQ ID NO: 103247 - DNA, 650 bp, Homo sapiens
  misc_feature: GYAE6OF02HNZ9E.3.34.D01.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctcgtggagatgcagttggacaaagctatatgcttacnggtaccagcaganccaggccaggccctgtggtgnatatagtaagcgtgagcgccctgaggactccgtagacgacgtaatctacgtggcctcganctacgaagggaacaacgtagtcctaacgttcgaacctataccggtaggtcggtaacgtccgaggaccgtaaggaacggtaaccggaggtacgttaacgtaaccgtaacgtacccgagttactaaaccgtaaatacggaacagtaaacccgagtaaccgtaaacgaccggtaaacccaaggtaccggtcggtacgggttagggttaccgggttaaccggggacgggtaaccggaaccgtaacggacccgttaccggaacccggttaccgtaacggttacccggtaacgggtacccctaacgggg

SEQ ID NO: 103248 - DNA, 784 bp, Homo sapiens
  misc_feature: GYAE6OF02GQX6E.3.34.D01.1.454.CMB.1.raw
tcagagacgcactccacgaccggtgctcgatttagatcgtctgtggttagggtttagggggtgggtcctaggaggcagaacgtctgggtagtactcaccatggcctggatccctctacttctccccctcctcactctctgcacaggctctgaggcctctatgagctgacacagccctacccgtcggtgtcagtcgtaccccaggaccagaccggccaaggatccaccgtgtccgtctgggaacgtattcggacctaggtttacggaactaaagaccttaatacgttcggtaccttaacggttcgtaacccgaggacgaacggacgaccgacggaccggacgtcccccgttgggtcgggtaggtacgtaactataagtaaacgaccggtaaggacggacggttccgacgaacgggtaccttccccgtaggacgtacggtaacgttctcgtacgtcgtacccgacggtacgtacggaacggtaactacggtaacgttaccgtacgtaccgtacctacgtaccgtagggttcggaacggttccgaaacggtcgaaacggtaggtaacggtcgggaacttaccggtaacgttaccgacgtacgttacggtaacttaaaccggtacgaaccggataaaccccgaggtaccgttaaacgaacccggtaacgtaaacggttcgggacggttacgttagggaccgggttacggggtaacctacggggtaacccgtacggttaccgacggttaccgtaaccggttacgtacggaccccggtagtaaccccggg

SEQ ID NO: 103249 - DNA, 766 bp, Homo sapiens
  misc_feature: GYAE6OF02JN8KK.3.34.D01.1.454.CMB.1.raw
tcagagacgcactccacgaccggtgctcgatttagatcgtctgtgttgggtttgggggtgggtccaggaggcagaactctgggtgtctcaccatggcctggatcctctacttctcccctcctcactctctgcacaggctctgacggcctcctatcgagctagacacagcccaccctggtgtcagtcgtccccgaggacgaggacggacgaggactaccaccgtgtcctcgtagggagtatcgtacctagttagggacctaaacggtcttaacgtacggtctaccgttaaggtaccggtaccgaaggacctaaggaacggtcccggaacgggaccgtaccggtccccgtgggtcgggtggtagtactaactaagtaacggacgtggacggtcgtaccgtaggacggtcctccggtaggactcggtaactcgtacgtcgctacacgtcgacgacgggtaacctacggtacgtcgttacgtcaactacgtacgtacgggtacgtaccggttacgacggtaggaacggtaacgcgggtagccgttaacgtactaaccggttctaaccggttgaaacgtaacgttacgacgtaacgactaacgggtctaaccggtaccgggaaacgacggttacggtcggttacgggtcggtttaaccgggggccgggtaagggaacccggtttacgggaaccggtttacccgtaaccggggttacccggtttaaaccggaccggttaaaccccggtccgggttaaccccgggaaccgggg

SEQ ID NO: 103250 - DNA, 771 bp, Homo sapiens
  misc_feature: GYAE6OF02JVSUO.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctcccctcctcactctctgcacaggctctggacgcctctatgagctgacacacgcccacccgtcggtgtcagtcgtccccgaggacacggaccggacaggactccacctgcgtcgtaggagtactgacgtagttcggaacaaacgtacgtaatcgtacgttaccgttacgtaccgtaaccgacgacgaacgtaaccgccgaacggcctacggtcccgtggtacggtggtagtaacgtaagtaacgtaaacggtaccggtaggaaccggaccggtccgtacggaacggtacctaccggtaggaaccggtaaccgtacgttacgtaccgtcgggtacctacggaactcgtaaccggaaacggaacctaacgtaacgggtaccgttaaccgtaacgtaaccctggtaccgtaggttacggtaaccggttaccggacggaacggaacgggtaaggaaccggtacgaccgttacgtacgttacgtaccgtaacgtacgtaacaaacgtacgacgtacaacgcgtaaccgaacgtaccggtaaacggtcgtaacggtacgttagggtacggttacgggtacgggtaaccgggtaaggaccggtacggttaacggtaccggtaaccggttacggtacggtaccgtaccggtaccggtaacccgg

SEQ ID NO: 103251 - DNA, 545 bp, Homo sapiens
  misc_feature: GYAE6OF02FJPB4.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggccccctgtcggtggtgatatataaagaccgtgagacggcctcgagggatccccgtgacgcgaatctcgtggctccagctcgaagggacaacgagtcacgttgaccatcagtggacgtccaggcaaggagacgaggtctagactatcacgtgtacaaagtacgacgagacagacaagtacgaaaccagttacggcgtagtgggtacgtcgggcggaacgggtaccgaaggtcgtacgaccgtaccgttaaggtcctacggacccgtaaccggg

SEQ ID NO: 103252 - DNA, 828 bp, Homo sapiens
  misc_feature: GYAE6OF02G5W1I.3.34.D01.1.454.CMB.1.raw
tcagagacgcactccacgaccggtgctcgatttagatcgtctgtgttgggtttgggggtggggtccaggaggcagaactctgggtgtctcaccatggcctggactccctctacttctccccctcctcactctctgcacaggctctgaggcctcctatgagctgacacgagcccacccgtggtgtcagtcgtccccaggacagacggccaggactccacctgctacgtggacatgactagttcggacaaacgtcttatagtcgtacgttaacgtacggtaaccgacggtacgaacggaaacgcccgaaccgggaccccgtaaccgggtcccccgttaggggttcggggttacggtacggttaaaccttaaagttaaaccggtaaaaaccgggtacccgggttaagggtaaccgggtaacccgggtacccccgtaacggtaaccggggttaaccctcccccggttagggaaccggtaccgtaaactttccggtaccgtcgggtaccctacccggtacgtaccgtaccggaacggtaaaccaaaccggtagtacccgttaacggttaaccgaactactaccggtagggttaacgaccggtaaccggtaaggaccgtaaaggaacggacggtacggtaacgttacgtaacctacgtaacctaacgtataacccgtaaagtaccgtacgaagtaacgacgtaaccgaaagttacccggaaaccgtaaggtccggttaacggtcgttagggtaccgggtacgggaccgggtaacggaacgtaccggttcgaacggttccccgtaagttacgaccggtacccgaccggttaccgg

SEQ ID NO: 103253 - DNA, 618 bp, Homo sapiens
  misc_feature: GYAE6OF02JEQ9S.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctctggagatgcagttggacaaagtctaatatgtcttactggtaccagcaagaacgccacggccacggcccctggtcggtggtagactataagtaaacggaccgtgaacggacggcccgtagacgggactcccgtggagaccgtaacttccgtcgtcgggcctaccgacgcgtacgaacgggaaccaacgacgtacctacgttacgaccatcgaggtggaacgtcgacggacgaaggaagacggaggtctagactactacacgtagtaactaaagtacgactaagacgacgaacgaacgtacggaacctaaggtagggtctaggttcgggtacggtccgggacgggacgggtaacgacgacgtccgtaccggtacgtacgtccgaccggacccgtaccgg

SEQ ID NO: 103254 - DNA, 781 bp, Homo sapiens
  misc_feature: GYAE6OF02F04NB.3.34.D01.1.454.CMB.1.raw
  modified_base (137)..(137): a, c, t, g, unknown or other
  misc_feature (137)..(137): n is a, c, g, or t
  modified_base (143)..(143): a, c, t, g, unknown or other
  misc_feature (143)..(143): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacnggctcngacggcctcctatgagctagacacacgcccacctcggtgtcaggtccgtaccccgaggacaggaccggccaaggactccacctgctcgtggagatcggatagttggacaaacggtctaatatgtccttagtacgtaaccgagacgaacgaacgcccgacggacccgtacggtccccgtgggtcgggttagggtacgtaagttaacgtaaaggtaaaaccggtaccgggtacggaacgggtaccggtccccgtaagggaccgggtacccttaccccggtagggaaaccggtacgttaaccgttccgttccgttaccgggacccttaccgggacgtttacccggacggaaaccggggtaaaacccaacggtaccggttaaccggtaccgtaccggtaaccacggtttaacgagggttaacccggacgttacccggggaagtaaccggaaccggtaaagggaaccggcgttacgttacgacctttaccggtacctacgtagaacctaaaggtacgacgaacgaacgacgtaactaaccggtaacgacgaagtcgggtcgtaggtggttccggtagggaaccgggtacgggtacaacggtcgtacggttaccgtaccgtaggcccgtaccggaccggtaccg

SEQ ID NO: 103255 - DNA, 854 bp, Homo sapiens
  misc_feature: GYAE6OF02G9ATA.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttcctccccctcctcactctctcgcacgaggctctgaggcctcctagtgagctgacacgacgcccacccgtcggtgtcagtccgtcccgaggacacggaccggccaggactcaccgtgctcgaggacgagtacgactagttcggaactaaaacgtcttataacgtcgtacgttacgtacggtaaccagacgaaggaacgccgaacggccacggacccgttaggtggtaggtagaattaagtaaacgttaaacggacggtacggacggtaccggtcccgtacgggaacgtacgtaccccgtaggacggttaccgtaaacgttccgttacggtacggtacccttaccggaaccggtcgtaaccgggaacggtaaaacccgaaactaacggttaccggtaaccggttacggaaccccgtagttaacccgaagggtcgggtaacccgttacggaaggaccgaaaggaaccgggtaaccggacggtactaaccggtaacgtttaactacgaaccgttaagtaaaccgtaagtacggtaaccgaacggtaaccgtaaagtaccggtaaaaccgttaccgggaaacgtaacgggtttacggaccggttttaggggtaccgggtttaaccggggtaccgggaacccggggtaaggggtaaacccggtaccggttaacccgtaaccgggtttaaccccgggttaaaccgtaaccgggtttaacccggaaccccggtaacccgggttaccggg

SEQ ID NO: 103256 - DNA, 844 bp, Homo sapiens
  misc_feature: GYAE6OF02JSS4X.3.34.D01.1.454.CMB.1.raw
  modified_base (145)..(145): a, c, t, g, unknown or other
  misc_feature (145)..(145): n is a, c, g, or t
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
tcagagacgcactccacgaccggtgctcgatttagatcgtctgtgttgggtttgggggtcgggtccaggaggcagaactctggggtgtctcgaccatggcctggatccctctacttcctccccctcctcacctctcgtcgcaccnggctcaggacggcctctatgagtctgacacncgtacccaccgttcggtntacctacgtccgtccccgaaggacaaggaccggaccaggactccgtaccgtncgtacgttacggacgtgtcgagtacgttcggacaacgttctaatgtcgttaccgttacgtacggtaaccaacgggtactaacggtaaccggtcccgacgggacccctccggggttaccccgttgggttacggggttggtaactagttaacgtaacgtaacccgggtagttgaccgggcccggaacccgtcggtaacggtaccttccggcgtacgtaaccgactttcccgtacgtacggttccctacgtaccggtacctaacgggttaccggaacccttaaacgttcgaaacccggttcgtttaacgaaccggttacgtaaccggtacgggtacggaaaccggttcgaacgggaactaaacgggaaccggtaaccggtcgggtacgtaccgttaactccgttaacgtaaccgttagtaccgtaaccgtacgttacgaagttccgaaaccgttaaccgaaccgggttaaccggtaaacccgttgtacccgggttagtcgggttaacgggttaccggggacgggtaaccgggtaaccggtaccgggaaccgtttcgaaccgggttcccgtaacgtacggtacccgtaccgacccggtacgg

SEQ ID NO: 103257 - DNA, 726 bp, Homo sapiens
  misc_feature: GYAE6OF02HBRBC.3.34.D01.1.454.CMB.1.raw
  modified_base (245)..(245): a, c, t, g, unknown or other
  misc_feature (245)..(245): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacacgacggccaggatcacctgctctggagatgcatggacaaagctatangacttactggtaccagcaagaagaccaggtcaacggcccctaggtggtggtagaataataacgtaaaagaccgtaggacggacggtcccgtacgaagggtacgtcccctaggacggacgaaatctcgtggcctaccacgccgtacaacggggacaaaccgtaggtaccgtaaccgtttacggaaccctaagttaccgtaaggttacggggaacgttaccccggaagggaccgaaacggaaaacgggaaccggaacgggtaccgttaacgggaaacttaacgtaccgtaaaccgttagtaaaccgaaaattaacggaccaagaacacggaactaaacgtaacgggaaacccctaggtaacgggtaccgttagggttacgggtttagggttaccggggaaccgggtaacggggaacccgtaaaggaccggttacgacccggttaaccgttaaccgggtaacgacccggtacccgaaaccgggg

SEQ ID NO: 103258 - DNA, 830 bp, Homo sapiens
  misc_feature: GYAE6OF02G1UFF.3.34.D01.1.454.CMB.1.raw
tcagagacgcactccacgaccggtgctcgatttagatcgtctgtgttgggtttggggggtgggtccaggaggcagaactctgggtgtctcaccatggcctggatccctctacttctccccctcctcactctctgcacaggctctgacggccctctatgagctgacacagcccacccgtggtgtacagtcgtccccgagggacaggtaccggccaagggactccgacctggtactcgtagggatagtcgacctagtttacgggaacaaacgtacttaagttacttggttaccgtttaacgttacgggtaaccaggaccgaaaggaaccgcccgaaaccggggcccaccgggtccccgtagggttcgggtacgggtaaggtaacttaagtaaacggtaaacggtaccggtaggaacggacggtaccctacgggaacgggtaccttaccccggtaggaacggtacccgtaattacgtcgtacgggtacctaccggtacgtaccgtaacggaagggtaacccaaacggtcggtaccgtaaccgttacggaaccacgtcggtaaacggggtaccgtaacggtacccggaaaggggaccgaaagggtaaaccgacggggacgttaacggttaccgtaaacctacgttacgtaacctaaggtaaaccaacgggtaagaaccgtaacgaacgaactaacggaaccggtaacgtaaaccgtaaggttaaccgggtcgtttagggggtacgttaccggggtcgggaaaccgggcgggtaaaccacggttaccgggtacgttaaccggtaccggtaacgccgtaccggaccttaacccggg

SEQ ID NO: 103259 - DNA, 692 bp, Homo sapiens
  misc_feature: GYAE6OF02GNP6O.3.34.D01.1.454.CMB.1.raw
  modified_base (245)..(245): a, c, t, g, unknown or other
  misc_feature (245)..(245): n is a, c, g, or t
  modified_base (525)..(525): a, c, t, g, unknown or other
  misc_feature (525)..(525): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgagcctctatgagctgacacacgccacccgttcggtgtcagttcgtccccaggacacggacgccgaggactccacctgctctggagatgctagtggacaaanctatatcgacttacgtggtaccagcgaacgaacgccgacggccgacggtcccctaggtgggtaggtacgtaagttaataaacgtaaaacggtaccggtaggaacggtaccggcccgtacggaagggtactcccgtaggaacggtaccgtaacgttccgtcggtcggtccctacgacgtacgtacgaagggaacctaacgtacgtacgtacgttacgaacctagtacgtagggtacggacgtaccgaagacgaacggaacgacggacgtcgtacgacttanacgtactagtactaaagtacggacaacgtacacggaactacggaaccgaaacgtagggtaccggtagtacgggttcgggtagggtcgggtacgggtaacgggaaccggtacggtaccggtacgtacccggttacggtaacgtacccggaccggtacccgtaacccgg

SEQ ID NO: 103260 - DNA, 859 bp, Homo sapiens
  misc_feature: GYAE6OF02FZ95L.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgcccaccctcggtgtcagtcgtccccgaggacacggacggccgaggatccacctgccttcgtagggagtatcgacgtagttcggaacaaagtctatactcgtactttacgtaggtaaccagacgaacgaaacggcccgaacgggtaccccgaaccgggtcccccgttggggttcgggttagggtacggtaaatttaagttaaaacggttaaaaaccggtacccgggtaggaaacgggtaccgggtccccgtaaccggaacgggggtaaccctccccggttagggaacggtaccggtaaacgtttccgtaccggttcgggttacccctaccggtaacggtaccgttaacggggaaacgggtaaaccctaaaccggtacggttaccgttaaccgggtttaacgaaccttacgtaccggtagggttaccggacggttacccgaagggaccgtaagggaaaccggtacgggaacggttcgtaaacgtaccttaacgttaccgtacgtttaaagaaccaaacgttagaacgaacggtaacacggtaacaaacgggttaacccggaaaccgtagggttaaccggtgttacggggttcggttcggggtaaccgggaacgggtaacgggtaacccgaacggttaccggtaccggttacccggtaaccggttaaccggccggtacccggccggttaaccgg

SEQ ID NO: 103261 - DNA, 719 bp, Homo sapiens
  misc_feature: GYAE6OF02INI4Y.3.34.D01.1.454.CMB.1.raw
  modified_base (292)..(292): a, c, t, g, unknown or other
  misc_feature (292)..(292): n is a, c, g, or t
  modified_base (450)..(450): a, c, t, g, unknown or other
  misc_feature (450)..(450): n is a, c, g, or t
tcagagacgcactccacgaccggtgctcgatttagatcgtctgtgttgggtttgggggtgggtccaggaggcagaactctgggtgtctcaccatggcctggactccctctacttcctcccccctcctcactctctgcacaggctctgacggcctcctagtggactcacgacacgaccgaccctacccgttggtacgtcgtcgttcccgaccggaagacggacggaccggacgaacgtactacctcgtcgtcgttacggtaggatagtccgattacggtacgaactaaacgtntacgttagtactacgttacgtacgactagacgaagaccgacgacgtaccgaccgtccggtaggtggttagacgtaattacgtaaaacgtaacggacgtaggaccgtacggtccgaggtaaccgtcctacgtacggacacgtactacgtcgtacgtccncgtacgtaccgtagggaacctaactaggtaacgtacggtactaccgactagtacggtagtacgtacggacgtacgaacgaacggaacggacggacgtaacgtacgtaactacgtacgaacgtacgtaagaactacgtaacgacgactaacgaacgtaacgaaaccgtaacggaacgttcggtaggttcggttacggtttacgggacgggtaccggtaacggacgtagtaccgtaccgttaacgcgtaacgaccgtaccggacgtaccgg

SEQ ID NO: 103262 - DNA, 716 bp, Homo sapiens
  misc_feature: GYAE6OF02J13DG.3.34.D01.1.454.CMB.1.raw
  modified_base (135)..(135): a, c, t, g, unknown or other
  misc_feature (135)..(135): n is a, c, g, or t
  modified_base (162)..(162): a, c, t, g, unknown or other
  misc_feature (162)..(162): n is a, c, g, or t
  modified_base (576)..(576): a, c, t, g, unknown or other
  misc_feature (576)..(576): n is a, c, g, or t
tcagagacgcactccacgaccggtgctcgatttagatcgtctgtgttgggtttgggggtgggtccaggaggcagaactctgggtgtctcaccatggcctggatcctctacttcctcccctcctcactctctgcanaggctcgtgacggcctcctatgagtcngacacacgccctacccgtcggtcgtacgacgtccgtccccgaggacgagaccggaccgaggctaccacctgtctcgtggagtatagcgtagttggacaacgtcttattatcgtaccgttacgtacggtaacacgacgaacgaaccgccgtaacggaccggaccggttcccgtggtgggtaggtacggtaagtaactaacgtaaacggaccggtagtacggacccggtccgtaacgtaccggaccgtccgtaggacgtactacgtcggtcgtcgcctacgtacgccgaggacgaacgtacgtacgtacttacggtaacacgtcgtacggtaggtacgtaacgtacggaacggtacgaaacggaacggtcggtaaccgtcttaacggtaaccgtcgttaccgtagtacgtaacganacgagaacgtacgaacggtacaaccggtaaacggaccggttaaagtcggtaggtttacgggtcggttaccgggagggaccgtacgggaacgtaacgtccggacgttaaccggagtaccggacgtaccggtaccgtaccgg

SEQ ID NO: 103263 - DNA, 814 bp, Homo sapiens
  misc_feature: GYAE6OF02IT7G9.3.34.D01.1.454.CMB.1.raw
  modified_base (156)..(156): a, c, t, g, unknown or other
  misc_feature (156)..(156): n is a, c, g, or t
  modified_base (164)..(164): a, c, t, g, unknown or other
  misc_feature (164)..(164): n is a, c, g, or t
  modified_base (182)..(182): a, c, t, g, unknown or other
  misc_feature (182)..(182): n is a, c, g, or t
  modified_base (566)..(566): a, c, t, g, unknown or other
  misc_feature (566)..(566): n is a, c, g, or t
tcagagacgcactccacgaccggtgctcgatttagatcgtctgtgttgggtttgggggtgggtccaggaggcagaactctgggtgtctcaccatggcctggatccctctacttctcccctctcactctctgcacgaggctctgacggcctctatgngctcgacncgacgccacccgttggtntcgtacgtcgtccccaaggacacggacggtccaaggctacgtacctgaccttcgtaggagtactcggtactacggttcggaactaaacggtccgttaattacgtagttaccgtttaccgttacgggttaacccagtaccgaacgaacggccccggtaaggcccccgttaacggtccccggttggtttacgggggtcgttacggtaactttaaggttaaacggtaaaacggccgggttagtacgggaaccgggtccccgtaggtaaacggggtccctaaccggtggaacgggtacctaacgttccgtcggtaccgtaacgtcccgacggttaacctcgggaaaccgggtaacccaaacggttcgttaccgttaacgggttaaccnccgtttaacggtcgtaaacgggtacgggtacggtaaccggaacggttaacggaacgaagggttaaccggacgtacgttaccaacgtttacaccgttacgttacgacaacgttacaacgtacgaacacggtaaccgaaacgggtcgaaacgcgggtacgtggttacggttacgggtaccggtcggaacggtacggtaccgaaggtaccgtaccggtaaccgtacgtaccggtacgacggaccgtaccgg

SEQ ID NO: 103264 - DNA, 819 bp, Homo sapiens
  misc_feature: GYAE6OF02JU8XA.3.34.D01.1.454.CMB.1.raw
  modified_base (620)..(620): a, c, t, g, unknown or other
  misc_feature (620)..(620): n is a, c, g, or t
tcagagacgcactccacgaccggtgctcgatttagatcgtctgtgttgggtttgggggtgggtccaggaggcagaactctgggtgtctcaccatggcctggactccctctacttcctcccctcctcactctctgcacgaggtctcgtgacggccttcctagtggagctacgacacacgccctaccgtcggtgtcacggtccgtacccgaggacgacggacggaccgtaggtactccgaccgtgccttacgaggaacgtagttcgacgtaaggttacggaacaaacgttcttaatacgtcttaccgttaggtaccggaaccagaacgtaacggaaccgaccggaccggacccgttaccggtcccggttgggtgggttacggtacgtaaacgttaaaagttaaaacggtaacggtaaccggtaggtaccggaacccggtcccgttaagggaacggttcccgttaccggaagaacgtaccggtaacgtccggttcgtacggtaccctacggaccgttacggtacgaaccggtaacacgggtaccgtaccgtagtaaccgtacaggtacggtacgacggtaaccgtcgggaagaacgtacggaagtacgacggtactagttacncggactacgtaacacgtaagacgacgtcgaaacgacgtaacggtaacgtaaccggtacgggaacgttacgggtaggtttcgggtaaacgggttcggggaaccgggtaaccggtaaacgggaaacccgttcgggtaacccgttaacggtaccccgggttacaacccggggttacccgaaccgttaccccgggtacccggg

SEQ ID NO: 103265 - DNA, 672 bp, Homo sapiens
  misc_feature: GYAE6OF02G220M.3.34.D01.1.454.CMB.1.raw
  modified_base (229)..(229): a, c, t, g, unknown or other
  misc_feature (229)..(229): n is a, c, g, or t
  modified_base (525)..(525): a, c, t, g, unknown or other
  misc_feature (525)..(525): n is a, c, g, or t
tcagagacgcactccacgaccggtgctcgatttagatcgtctgtgttgggtttgggggtgggtccaggaggcagaactctgggtgtctcaccatggcctggatccctctacttctccccctctcactctctgcacaggctctgacggccctcctatggagctgacacagcccacccgtggtgtcagtcgtccccaggacagacggccaggatccacctgctcgtagganattggactagttcggaacaaaagtcttatagtcgtaccttacgtacgtaccgagactaagacgacgacggccgaacggtcccgtaggtcggtaggtcgtaataagttaacgtaaacggccgtaggagtaccggtccgtacggaggtactcgtacgagactaacgtctcgtaggtacctcgacgtcgtaccggaaggaacctaaacgacgtactacggtacgtaaccacgtacggagggtacgtacgggtaccgaggtaacgaacggtaacggaggtacggcgttaacgtaactacncgttaacgtgaactaagaacgacctaagaccgagaacgtaacgtacgaacgtaagtaagtccggttaggtcggttacggtcggggaccggaaggtaccgacgtacgtaacggccgttaccggtaactaccggacgtaccgtaccggg

SEQ ID NO: 103266 - DNA, 732 bp, Homo sapiens
  misc_feature: GYAE6OF02G5BXO.3.34.D01.1.454.CMB.1.raw
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
  modified_base (679)..(679): a, c, t, g, unknown or other
  misc_feature (679)..(679): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgcacaggctctgacggccctctatgagctgacacacgccctacctcggtgtacgtacgtccgtccccgaggaaccgacggaccggaccgtaacggtaactccgaccgtcgtccgttcgtagggaagattcggactaggttggaacctaaagtaccttataacgtcgttaccttaacgtaccggtaacgacggngtaaggaaccgcgtaccggaccgaccggtcccgtaggttcggngtaataagtaataaacgtaaacggaccggtagaaggcccgtaccgacgagggtacctcggtacggaagacccgttaatccgtacgtcgccttaccgacgtccggtaagaacgggaaacctaacgnttaacccgngttacactagtacgnggtcgtacggtacgacggtagaacggtaacgacgagtcgaacgtaacgtactcgaattacgaaacaagttcgaacgtagaacgtaacgactaaaccggaccaaacgtccgggtaagtcggttacggtcgggtacgtaacggggacggtaacgggtaaacncggtaccttacgggtaccgtaaccgtaacgtacccggacgtacccgtaaccgg

SEQ ID NO: 103267 - DNA, 886 bp, Homo sapiens
  misc_feature: GYAE6OF02HH193.3.34.D01.1.454.CMB.1.raw
  modified_base (531)..(531): a, c, t, g, unknown or other
  misc_feature (531)..(531): n is a, c, g, or t
tcagagacgcactccacgaccggtgctcgatttagatcgtctgtgttgggtttgggggtgggtccaggaggcagaactctgggtgtctcacatggcctggatcctctacttcctcccctctcactctctgcacgaggtctctgacggccctcctatgagccgacacacgcccacccgtcggtgtcgacggtccgtaccccgaggacgaacggaccggccgaaggactcaccgcgtctacgtggagacgtgactagttacgacgaaacgtgttaatagtagttaccgttaccgtacggtaccgacgacgaacggaacggaccgtaccgggaccggaccgtccccggttgggtaggtcgggtactaagttaagtaaacgtaaacggtaccggtaggtaagaccggggtaccccttaggaaccggaccgtttccgacgaaggacgtaactccgtcgtcggtactaccggtacgcgtaacggaacggtaacgaacttacggtaccgtaacgtaccgggtaacctagttaccgggngtacggggtaacctaccggacgaacggaacgggaaacgggtaacggacggtacgtaacggtaacctttaaccgtacgttaaccggtaaacggtaaattaacgggtaaacccgaggaaaccgaacgtttacccgaaaacggtaaaccgttaaccgggtaaaaccggggtaaaccctttaacgggggtaccggttcggggtttttaccgggggaacggggtttcccgggggaaaacccggggggttaaccggggtaaccggaaccggtttaaccgggacccggttttaaaccccgggtttcggaaaacccggttcccgggttaaaacccggaccccgggtaaccggtaacccccggg

SEQ ID NO: 103268 - DNA, 824 bp, Homo sapiens
  misc_feature: GYAE6OF02GZU2Z.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctggacggccctcctatgagctgacacacgcccacccgtcggtgtcagtcgtcccaggacaggaccggccaggactccacctgctcgtagggagagtcgcgtagttcggaactaaagcttaattacgtcgtctttaaccgtacggttaacccaggtacgaaggaaaccgccgaacgggccctaaccgggtccccccgttggttaggggttagggtacggtaacttaaagtttaaacgtaaaaaccgggtacccgggtagggaacgggaccgggtaccccgttacggaaggggtaccttaccccggtagggacgaccgtaaaccgttccgttacggtaccgggtccttacccgtacggtacccgttaacggaacggggtaacccaaacgtacggttacccgttaacgggtttaaccgaccctaacgtcgtaacgggtacggggaccgtaccgggaacggacgtaaacgggaacgtaacgggacggacgttacgtacgttaactaccgtacgtacgaacttaaacggacgacgtaacgaacgacgtaacgtaacgtaaccggtaaacccgtagggtacgggttcggtagggttcgggttacgggtaccgggaacgggtaccgggaaaccgaggtaccgacgggttacccgtaccgttaacggtacgaccgggtacctacccgggg

SEQ ID NO: 103269 - DNA, 917 bp, Homo sapiens
  misc_feature: GYAE6OF02JUG7E.3.34.D01.1.454.CMB.1.raw
  modified_base (604)..(604): a, c, t, g, unknown or other
  misc_feature (604)..(604): n is a, c, g, or t
tcagagacgcactccacgaccggtgctcgatttagatcgtctgtgttgggtttgggggtgggtccaggaggcagaactctgggtgtctcaccatggcctggactccctctacttcctccccctcctcactctctgcacgaggtctcgtgacggccttactagtgagtctcgacacacgccctaaccgtcggtgtctacgtccgtaccccgaagggaccacggtaccggaccgtaaggcttcccgtaaccgtcggtcccttacggtagggtacgagtcggaccttaggttaccgggaactaaacggttcttaagttcgttacgttaacccgtttacggttaccggaacctaacgaccggtaaaggaccccgggacccgtaccgggtaacccgtaccccgggtccgtttggggttcgggtaccggtaggtaaacctttaaggtaaaaccgggttaacggaccggttagggaaccgggttaccggtccgtcgggtaaccggtcctaccggtagggacgtaaccgtagtcccgtacgccggttaccacgtacgaccgtacggtaacggaactacgtaccggtacttacggtacgtaaccgtgtacggnggttacgtaacgtacccgaaaggtaccggtaaacggaccggaacggtacgggttattaaccggacgtttaacgtaacgtacggtttacgaaaacccgtaacgttaaccggaccgtaacgtaaaccggaacccggtaacgtaaacgggttaaccggaaacccggtttagggttaccggtacgggtttacggggttacgggtttaaccggggtacccggggtaaccggggaaacgtaaccggtaacccggtaggttaccccggttaaccggaaccggttaacccgtacccgtaccccggggtacctaccccgggg

SEQ ID NO: 103270 - DNA, 750 bp, Homo sapiens
  misc_feature: GYAE6OF02JTWTV.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacacgccacccgtggtgtcagtcgtccccaggacagacggccaggactccacctgctcgtggacatcgctagtggacaaagtctagtatcgtacttacgtacggtaccagtacgaagaacgaccgacggaccgaacggtcccccgtggtacggtagggtaggtacgttaattaacgtaaaaccggtacccggtaggtaaccggtaacgggtaccctaacgggtaacgggtaccttccccggtaggaaaccggtacgtaaacgttcgtccggtacgtacccgtacgtacgtacgttaccggaacggaaccgtaaaccgtacggtacctacgttacgaactagtaccgtaggacgtacgtaccggaggtaacaacgggtaaacggacggtacggtaacgtacgtaaacgtaccgtactacgttaacggaactaaacgtacgacgtaagtacgacgtaactaacggtaaccggtaaaccgtagggtagttacccggtaggttgggttaaccgggtacgggtaacgggaacggtaccgttaacgaccgtacggttaccgaaccgttacgtaccggaccggtaccctaacgg

SEQ ID NO: 103271 - DNA, 800 bp, Homo sapiens
  misc_feature: GYAE6OF02HDDR8.3.34.D01.1.454.CMB.1.raw
tcagagacgcactccacgaccggtgctcgatttagatcgtctgtgttgggtttgggggtgggtccaggaggcagaactctgggtgtctcacatggcctggatccctctacttctcccctcctcactctctgcacaggctctgaggcctcctatgagctgacacacgcccacccgttcggtgtcagtcgtccccaggacagacggccaggtatcacctgcttcgtaggagatcgactagttcggacaaagtcttagtatcgtactttacgtacggtaaccagacgtaacgaacggcccgaacgggacccgacggtccccgttgggtacgggttgggtacgtaatttaagtaagtaaacggtaccggttagaacgggtacgggacccgtaggaacgggtacctccccggtagacgtacgaacttccgtacgtacggcctaccgacgacgtacggaacgggtaacaacgtacgtacgtacggttacgaaccagttacgaggtacgggtaacggtaccgagggaccgaagggaacgtacgggtacggacgttaacgtaaccttaagtaccgttaccgttaagttaaccgaaggttaaccgacgtaaacgaacgtaacggaaccgttaaaaccgaaccgggtaaaacccgttaggggtaaccgggttcgtacggggtttacgggttaccggggttaacccgggggtaacggggtaaacggggtaacccgtaaccggggtacgtttacccggaacccgggtttaacccgtaacggccccggttaaaccggacccgggtaaccccgg

SEQ ID NO: 103272 - DNA, 782 bp, Homo sapiens
  misc_feature: GYAE6OF02F17R9.3.34.D01.1.454.CMB.1.raw
  modified_base (557)..(557): a, c, t, g, unknown or other
  misc_feature (557)..(557): n is a, c, g, or t
  modified_base (630)..(630): a, c, t, g, unknown or other
  misc_feature (630)..(630): n is a, c, g, or t
tcagagacgcactccacgaccggtgctcgatttagatcgtctgtgttggggtttgggggtgggtccaggaggcagaactctgggtgtctcaccatggcctggactccctctacttcctccccctcctcactctctgcacaggctctggacggcctcctagtgagctgacacacgccctaccccgtcggtcgtctacgttccggtaccccgaggacacggaccggaccgagggtaactcaaccgttgaccgttcgtacgggagtacgtcgacgtaagttcggaactaaacggacttagtattcggttaccttacgttacggttaacccagtacgaaacgaacgaccgacggcccgaacggtcccccgtaggttcggtaggttacgtattaacgttaaacgtaaacggtaccggttaggaacggtaccggaccccgttaggaacgggtccttccccgtagggaacgtaccgttaacgttccgttacggtcggtccgttacccgagtaccggtacggaaccgggaactaaccgtacgtacggttaccgtcgaaccgttanaccgtaggttacggacgtacgaggtacgaacgaagggaccgacggtacgtactaaccttactaccgtaacgtntaacgtaaagtacgacgacgtacgactaacgtaacgtaccgactaaggtacggtcgttgggtaggtaccgggttacgggaacggtaacggtacccgaggttcccgacgggttaacccgtacggtaaccgaccggtaccgaccggtaacccgg

SEQ ID NO: 103273 - DNA, 673 bp, Homo sapiens
  misc_feature: GYAE6OF02F1X85.3.34.D01.1.454.CMB.1.raw
  modified_base (180)..(180): a, c, t, g, unknown or other
  misc_feature (180)..(180): n is a, c, g, or t
  modified_base (516)..(516): a, c, t, g, unknown or other
  misc_feature (516)..(516): n is a, c, g, or t
  modified_base (578)..(578): a, c, t, g, unknown or other
  misc_feature (578)..(578): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgacggcctctatgagctgacacagcccacccgtggtntcagtcgtccccaggacagacggcaggatccacgtgctcgtggagatgctagtggacaagctatatcgtctacgtggtaccagcaagagccgaggcccgacggccccttggtgggttaggtcgtattaagtaataaaacggtaccggtaggaacggaccggacccttcggaacgggtaccttccgtagacggtaccgtaacgttcctacggtccggaccttaccgacgaccgtcgaaacgggtaccaacgtagtccgtacgtttacgaccctagtacggacggttacggaccgtaccgtagaaccgaggtaaacgaccggaggcttacgacttacncgtactcgtaaataatcggacaacggtacaacgacgtaacgtaccgaaacgtcggtacggtnttagggttcgggttcgggtaacggtcggggaaacggtaacgtacgtcccggtaacggttacccgtaccgaacgttccgaccggacccgtaccggg

SEQ ID NO: 103274 - DNA, 695 bp, Homo sapiens
  misc_feature: GYAE6OF02GFTB7.3.34.D01.1.454.CMB.1.raw
  modified_base (182)..(182): a, c, t, g, unknown or other
  misc_feature (182)..(182): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgacggcctcctatgagctgacacagcccacccttcggtntcagtcgtaccccaggacaggacggccaaggtactccacctgccttcgtaggagatcgacagttggaacaaagctaatactcgtacttacgtacgttaaccagactaacgaacgaccgaacggacccgtacggtaccccgttggtcggttacggtaggtaattaagtaaacgtaaaacgtaccggtaaggaacggaccggtacccgtacgaacgggtactcccgagtacgacgtaacgtctcgtcgtcctacgacgtcgtacgacggaacaacgcgtacacgtacgacgatacgagaggacgtacgaaggcgaacgaggacgacggtactacgtaacgttacacgtactacgtactaaacgtacgaactaacgactaacgtaacgtaacgaacggtaaccaagggttacgtaccggttaggtcgggtttacggtacgggaccgggaacggtaaccgtagtaccgtaaccggttaccggtaccgtaaggtacccgacggtacccgtaacccggg

SEQ ID NO: 103275 - DNA, 597 bp, Homo sapiens
  misc_feature: GYAE6OF02G5XXW.3.34.D01.1.454.CMB.1.raw
  modified_base (179)..(179): a, c, t, g, unknown or other
  misc_feature (179)..(179): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctggagatgcattggcaaagctatatgcttactcggtaccagcagacgccaggccacggcccctggtggtggtgagtataataaagaccgtagacgacggtccctgacgggactcccgtaggacgacgaatccgtctcggtcctccacgtctcggaacgggtacaactcggtactacgtcgaccatacgaggtcggagtcccgaaggccaaggaacggacgaggcttagactacgtaccagtacgtacaaatacgacagacagacaagtacggaaacccagtacgggtcttgggttacggtcggttacgggacgggtaaccgggaccgtaacggccgtaccggtaccggttaccgtaaggtccgacggtacccgtaaccgg

SEQ ID NO: 103276 - DNA, 848 bp, Homo sapiens
  misc_feature: GYAE6OF02FLZNP.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgggagatcgctagttggacaaaaggtctaatagtcggtactttacgttacggtaacctacggacgaacgaaacggccccgaacgggtaccccgaacgggtaccccccgttagggttacggggttacgggtagtaaagttaacttaaacgttaaaaacgggtaacccgggttaggaaacgggaaccgggtacccccgtacggtaacggggtacgttacccccgttaacggaaggtaccggtaaactttcccggttacggttacggggtcccttaacccggtacggtacccgttaccggaaacgggggtaaaccctaaaccgtaccgggttaccgtaaccgggtttaccggaacccttacgtacggtaacggtcgggtaaacggtcccgaaacgggtcgaaacgggaaacggtacgggaacgggtaccgttacggaaccttaaccgttacccgtaacgtttacggtaaaccgtaaacgttaacgacgtaaacgaacgtaacggacgtaaaacgtaaccggaaacgtacgtacgggtagttacggtgggttacggttacgggtcgggaacggtaaccgaacgttaccggtacggacccgttaccgttaacggtccgaacggacccgtaaccggg

SEQ ID NO: 103277 - DNA, 797 bp, Homo sapiens
  misc_feature: GYAE6OF02FJVI6.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagcccacccgtcggtgtacaggtcgtccccgaggaccaggaccgccgaggactcgaccgtggcctcgtgggagactcgactagttggaactaaagtcgtaatagttcgacctttacgtcggtaaccacgacgaacgtaacgcccgaacgggtcccgaaccgggtccccgttcgggttacgggggttacgggtagtaaacttaacggttaaagtaaaacggtaacccggtaggaacgggaaccgggtccccgtaacggtaaccggggtaccgttccccggtaggaccggtaccgtaaaccgttccgtacccggtacggtcccctaccggtacggtaccgtaccggaacggggtaaaccctaaccggtaaccggtacccggtaaccggtttaccgaacccgtacgtaccggtaacggttaacgggcccggttaacccgacgggaacgaaacgggaacgacggacggtacgtacgtaaccgtacgtacctaacgttagaaactaacgtacgacgtagaacgacgtaacgaaacgtaccgaacgtaacgtcgtacgtcggcggttacggtacgggaccggtacggtaacgtacgtacggtaccaaccggtactacggaccgtacgacccgtaccgg

SEQ ID NO: 103278 - DNA, 760 bp, Homo sapiens
  misc_feature: GYAE6OF02GSSK1.3.34.D01.1.454.CMB.1.raw
  modified_base (254)..(254): a, c, t, g, unknown or other
  misc_feature (254)..(254): n is a, c, g, or t
  modified_base (569)..(569): a, c, t, g, unknown or other
  misc_feature (569)..(569): n is a, c, g, or t
tcagagacgcactccacgaccggtgctcgatttagatcgtctgtgttgggtttgggggtgggtccaggaggcagaactctgggtgtctcaccatggcctggatccctctacttctcccctcctcactctctgcacaggctctgaggcctacctatgagcagacacagcccaccctcggtgtcagtcgtcccagacagacggcaggatccgactgctcgtaggagatgcagttacggacgtaaaacgtctaatancgtacttacgtacggtaccctagactaacggaagaccgtacggacgacgggtacccctgggtacggttggacggtataactaagttaaacgaccggtaggaacggtaccgacctgtaacgggtactacccgaggtacacggtaacctcgtaccgtcgacctacgtagaccgtagaacggggtactaaacgtacggttaccgaagttccgtaacctacgtacgtaacgggtcggtaaactcgaacgggtacaaagggtaaacgaccgggtaacggttactaacggaaccttaacgttacctaacggtaacgttaanaaaccggtagtaacgaacgtactaacggaacgaaccgtaacgtaaacccgtaagtaccgggtacgttaggtaccgggttacggtccgggaaccgggttaacggggaacccgtaacggtccggtaaaccgggtaaccccgttttaacccgggaaacggttacccgggtaaccgtaccggggtaaaccccggg

SEQ ID NO: 103279 - DNA, 909 bp, Homo sapiens
  misc_feature: GYAE6OF02I8O7O.3.34.D01.1.454.CMB.1.raw
tcagagacgcactccacgaccggtgctcgatttagatcgtctgtgttgggtttgggggtgggtccaggaggcagaactctgggtgtctcaccatggcctggatccctctacttctccccctcctcactctctgcacaggctctgaggcctcctatgacgctgaccacacggcccacccgtcggtgtacacgttcgtccccaaggacaggaaccggcccgtaaggacttccaacccgtgtaccttccgttagggaagtacgttcggacttacggtttcgggaacctaaaggcctttaaagtacgttacgtaccgttttaaccggtacggttaacccaaggtaccgtaacggaaacggtacccgtacggggaccccgtaacgggtccccccgttggggttacgggtacgggttacggtaacgttaacggttaaacgttaaaaccgggtaaccccgggttaagaacgggtaaccgggttacccccgtaccggtaaccggggtaaccgtttcccccggtaggaaccggtaaccgggtaaacctttcccgtacccgggtttacggtaccccgtttaacccggacgtacccggttaaccggaaacggggtaacccgtaaccggtacggttacccggtacgtttaaccgaaccgtacgttacggacggtcggtaccggtaccgagtacgaacggtaaggaccggtaggaccgtaacgtactacgtacgaaccgtttagacgtaaacgtagaccgacggaacaaggttaccctaaacggaaccgtaaacccgtacggtaaaccggtccggttaggtcgggttaccggtacgggtaccggaaccgggtaaccggtaccggaccgttaaccggaccggtttccgtaacgttaccggacccggttaacccggaacccggg

SEQ ID NO: 103280 - DNA, 750 bp, Homo sapiens
  misc_feature: GYAE6OF02F9TD3.3.34.D01.1.454.CMB.1.raw
  modified_base (143)..(143): a, c, t, g, unknown or other
  misc_feature (143)..(143): n is a, c, g, or t
  modified_base (255)..(255): a, c, t, g, unknown or other
  misc_feature (255)..(255): n is a, c, g, or t
  modified_base (617)..(617): a, c, t, g, unknown or other
  misc_feature (617)..(617): n is a, c, g, or t
tcagagacgcactccacgaccggtgctcgatttagatcgtctgtgttggggtttgggggtgggtccaggaggcagaactctgggtgtctcaccatggcctggatccctctacttcctccccctctcactctctgcacaggctntgaggcctctatgagctgacacacgccctaccgtggtctacacggttccgtaccccgaggacacggacggtaccgaaggtactaccgaccgtgccgtttacgagggaacgtntcggtactacgttacgggacctaaaagctttaatacgtcggttacgttacggttaccggtaactacggacgtaacggaaccggccggtacggcccgtaccgggtcccgttagggttacgggtaggtagtaacgttaagtaaaccggtaaacggtaccggtaggtaacggccggtaccgtaacggacgggtaccttaccggaggaacgtacgtaacgttccgtacgtacggcctacgacgtactacggaacggtaaccaggtacgtacccgtacggtactaccgtacgtacggtacggtagaccgtacggaggtaccaaagggacggacgcggtaactacggatccgaacgtcgttaagtaanaacgtacgacgaagactaggtaacaccgtaaacgacggttaggagttaccggtgtaccggttacggacgggacgtaaccggacgtagttaccggaccgttaccggtacttaacggccgtacggaccgtaccgg

SEQ ID NO: 103281 - DNA, 938 bp, Homo sapiens
  misc_feature: GYAE6OF02HMT4U.3.34.D01.1.454.CMB.1.raw
  modified_base (225)..(225): a, c, t, g, unknown or other
  misc_feature (225)..(225): n is a, c, g, or t
  modified_base (710)..(710): a, c, t, g, unknown or other
  misc_feature (710)..(710): n is a, c, g, or t
  modified_base (783)..(783): a, c, t, g, unknown or other
  misc_feature (783)..(783): n is a, c, g, or t
tcagagacgcactccacgaccggtgctcgatttagatcgtctgtgttgggtttgggggtgggtccaggaggcagaactctgggtgtctcaccatggcctggatccctctacttctccccctcctcactctctgcacgaggctctgacggcctcctatgagctcgaacacacgcccacccgtcggtgtacgtagtcgtaccccgagggaccacggacggccgaganccacgtgtactcgtaggagatgactagttcggacaaagtactattagtacgtacttacgttacggtaccgaagtccgaagaacgaccgaacggacccgaaccggtccccgttaggtagggtacgggtacgtaattaacggtaaactaaaacggtaccggttacggaacgggtaaccgggtaccccacgggtaacgggtaaccttacccggttaggaacggtaccgggtaaacctttcgttacccggtcgggtaccccttagaaacccgtccggttaaacgggaaaccggtaacctaaaacggggtacgttaaccggtaaacccgggttttaactaaaccggtaacgtaccggttacgggggaacggttacccggtaaaccgggttaaaggaaccgtaaaaccgggaaaagggtacccgaaggggtccgttaaaacgtttacgtaacccgttaactacccggggttaaattaaccgaaaacgggtnttaaaacccggacggttaaaacaaacgggttaccggttaaaaccgaaaccgggtaaacccgggtttaaaccgnggggtttacccgtagggggtttttacccggggtttacggttaacccggggggacggggttaaaacccgggttaacgcccgggttaaagtacccccggttttaaccgaacccgggttaacccgtaacccggaccggggttaaaccccggtaacggg

SEQ ID NO: 103282 - DNA, 605 bp, Homo sapiens
  misc_feature: GYAE6OF02JHPAA.3.34.D01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagagacgcactccacgaccggtgctcgatttagatcgtctgtgttggggtttgggggtgggtccaggaggcagaactcgtgggtgtctcaccatggcctggactccctctacttcctccccctcctcactctctgcacaggctcgtgacggtcccttacctatgagctagaacacagcccacccgtggtntcngtccgacccgagacacggcggccaggactccacgtgctgaggagatgctagtggacaaagtctaatgtgtacttacgtacggacagacagaacgcgaagccgtacggcccgtgtaggtgtagataataacggtaaacgcgagacgacgcctagagtccncgtagaacncgtatcgtcagctacgnacgtacacggaactacagtaccgagtaacgctacgtacgagcgacgacagtaacaagaacgaagacgacgttactcgtaacgctaacgttacaaacggtaagaacgacgaacaacgtaacaacgtaacgtacgaaacgtagtacggtcgtaggtcgggtacggtcgggaaggacgtaacggactaccgggtagttaccgtaccgtacgaaccgtacgaccggtcg

SEQ ID NO: 103283 - DNA, 184 bp, Homo sapiens
  misc_feature: GYAE6OF01BTX25.34.34.D01.1.454.CMB.1.raw
  modified_base (164)..(184): a, c, t, g, unknown or other
  misc_feature (164)..(184): n is a, c, g, or t
tcagtacacgtgatcacgaccggtgctcgatttagatcgtctgtgttggttgggaaggaggaagactgacggtcccaggagttcaggtgctggcacagcggcctggctgcctggtcaaggctacttccatcacgtgtactgagcgggctggcaaggcgcatagnnnnnnnnnnnnnnnnnnnnn

SEQ ID NO: 103284 - DNA, 252 bp, Homo sapiens
  misc_feature: GYAE6OF01DD8R3.34.34.D01.1.454.CMB.1.raw
  modified_base (251)..(252): a, c, t, g, unknown or other
  misc_feature (251)..(252): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttccgcatctgaatcacgtgtactgagcgggctggcaaggcgcatagnn

SEQ ID NO: 103285 - DNA, 249 bp, Homo sapiens
  misc_feature: GYAE6OF01DUCFP.34.34.D01.1.454.CMB.1.raw
  modified_base (245)..(249): a, c, t, g, unknown or other
  misc_feature (245)..(249): n is a, c, g, or t
tcagtacacgtgatcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccatcacgtgtactgagcggctggcaaggcgcatagnnnnn

SEQ ID NO: 103286 - DNA, 173 bp, Homo sapiens
  misc_feature: GYAE6OF01C2MGR.34.34.D01.1.454.CMB.1.raw
  modified_base (173)..(173): a, c, t, g, unknown or other
  misc_feature (173)..(173): n is a, c, g, or t
tcagtacacgtgatcacgaccggtgctcgatttagatcgtctgtgttgggtttgggggaagaggaagactgacggtcccccaggagttcaggtgctgggcacagcggccctgggctgcctggtcaaggactacttccatcacgtgtactgagcgggctggcaaggcgcatagn

SEQ ID NO: 103287 - DNA, 223 bp, Homo sapiens
  misc_feature: GYAE6OF01A9KFH.34.34.D01.1.454.CMB.1.raw
  modified_base (222)..(223): a, c, t, g, unknown or other
  misc_feature (222)..(223): n is a, c, g, or t
tcagtacacgtgatcacgaccggtgctcgatttagatcgtctgtgttgggtttgggtacgatttgatgttacctgatgcttagaggctttcctggaagcagggcatttgttgcttcagcaccgtagtgcctcgtcatcacgcctcagccttgattttccggatttgcctggtcaaggactacttccatcacgtgtactgagcgggctggcaaggcgcatagnn

SEQ ID NO: 103288 - DNA, 494 bp, Homo sapiens
  misc_feature: GYAE6OF01AUFAF.34.34.D01.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
tcagtacacgtgatcacgaccggtgctcgatttagatcgtctgtgttgggtttggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctganattctgctactttatactgtcagcagtctaatagtggccgtggacgttggccaagggaccaaggtggaatcgaaacgactgtacggtctagacacngtctcg

SEQ ID NO: 103289 - DNA, 251 bp, Homo sapiens
  misc_feature: GYAE6OF01CRHTR.34.34.D01.1.454.CMB.1.raw
  modified_base (249)..(251): a, c, t, g, unknown or other
  misc_feature (249)..(251): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatctccgcatctgaatcacgtgtactgagcggctggcaaggcgcatagnnn

SEQ ID NO: 103290 - DNA, 249 bp, Homo sapiens
  misc_feature: GYAE6OF01A504W.34.34.D01.1.454.CMB.1.raw
  modified_base (246)..(249): a, c, t, g, unknown or other
  misc_feature (246)..(249): n is a, c, g, or t
tcagtacacgtgatcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccatcacgtgtactgagcgggctggcaaggcgcatagnnnn

SEQ ID NO: 103291 - DNA, 189 bp, Homo sapiens
  misc_feature: GYAE6OF01DYIBI.34.34.D01.1.454.CMB.1.raw
  modified_base (175)..(189): a, c, t, g, unknown or other
  misc_feature (175)..(189): n is a, c, g, or t
tcagtacacgtgatcacgaccggtgctcgatttagatcgtctgtgttgggtttgggggaagaggaagactgacggtcccccaggagttccaggtgctgggcacagcggccctgggctgcctggtcaaggacttacttccatcacgtgtactgagcgggctggcaaggcgcatagnnnnnnnnnnnnnnn

SEQ ID NO: 103292 - DNA, 504 bp, Homo sapiens
  misc_feature: GYAE6OF01DASOQ.34.34.D01.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagtacacgtgatcacgaccggtgctcgatttagatcgtctgtgttgggtttggggaggaactgctcagttaggacccagaccggaaccatcggaagccctagcgtcagcttctcttcctcctgctactctggctcccagacaccacttggagaaatagtgatgacgcagtctccagccaccctgtctgtgtctccaggggaaangccaccctcncctgcagggccagtcagagtgtggcagcaattgcctggaccagcagaaacctggccaggctccagatctcatcatgctacatccaccaggccactgctatccanccaggttcagtggcagtggtctgggacagacgttcactctcaaccatcagcagcctgcagtctagaagattctgctactttattactgtcagcaagtctaaataagtcggccgttggacgtttcggccaaagggaccaaaggtgggaaatacaaaacgaactgtggtctagacacccaatctcg

SEQ ID NO: 103293 - DNA, 257 bp, Homo sapiens
  misc_feature: GYAE6OF01AYKTL.34.34.D01.1.454.CMB.1.raw
  modified_base (251)..(257): a, c, t, g, unknown or other
  misc_feature (251)..(257): n is a, c, g, or t
tcagtacacgtgatcacgaccggtgctcgatttagatcgtctgtgttgggtcgtgggacagagttcactctcaccatcaacagcctgcagtctgaagattctgcactttattactgtcagcagtctaataagtggccgtggacgttcggccaagggaccaaggtggaaatcaaacgactgtggctgcaccatctgtcttcatcttccgcatctgaatcacgtgtactgagcgggctggcaaggcgcatagnnnnnnn

SEQ ID NO: 103294 - DNA, 516 bp, Homo sapiens
  misc_feature: GYAE6OF01CDY16.34.34.D01.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccgtgtctgtgtctccgaggggaaanagtcaccctctcctgcagggccagccagagtgttagcagcaacttggcctggtaccagcagaaacctggccaggctccaggctcctcatctatgtgcatccacagggccactggtactccagccaggttcagtggcagtggtctgggacagaattcactctcacatcagcagcctgcagtctagaatntttgctagtttatactgtcagtcaagttaataagtaacgtggaccgtcgggtacgttcggaccgaagggtaccaaagggtcgaaattcgaaagacttggaggctaggcctacatctgtcttacg

SEQ ID NO: 103295 - DNA, 549 bp, Homo sapiens
  misc_feature: GYAE6OF01DY40M.34.34.D01.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctcccagacgtcctcatctatgctacatccaccaggccactgctatccagccaggttcagtgcagtgggtctgggacagngttcactctcaccatcagcagcctgcagtcagaatattctgtctactttattacgtgtctagtctagttactaaagttaagtcggtaccggttaggaccggtttcggaccgtaaacgggaaccgtaaaggggtcggaaaattacgaaaacggtacgtacggttacggacttcggacctacctagtcgttacgg

SEQ ID NO: 103296 - DNA, 182 bp, Homo sapiens
  misc_feature: GYAE6OF01CMEJG.34.34.D01.1.454.CMB.1.raw
  modified_base (172)..(182): a, c, t, g, unknown or other
  misc_feature (172)..(182): n is a, c, g, or t
tcagtacacgtgatcacgaccggtgctcgatttagatcgtctgtgttgggtttgggggaagaggaagactgacggtcccccaggagttcaggtgctgggcacagcggccctgggctgcctggtcaaggctacttccatcacgtgtactgagcgggctggcaaggcgcatagnnnnnnnnnnn

SEQ ID NO: 103297 - DNA, 258 bp, Homo sapiens
  misc_feature: GYAE6OF01A32CZ.34.34.D01.1.454.CMB.1.raw
  modified_base (226)..(226): a, c, t, g, unknown or other
  misc_feature (226)..(226): n is a, c, g, or t
  modified_base (253)..(258): a, c, t, g, unknown or other
  misc_feature (253)..(258): n is a, c, g, or t
tcagtacacgtgatcacgaccggtgctcgatttagatcgtctgtgttgggtctgtgacagtagttcactctcaccatcagcagcctgcagtctgaagattctgctactttattactgtcagcagtctaataagtggccgtggacgttcggaccaagggaccaaggtgaaatcaaacgactgtggctgcaccatcgtgtcttcatcttcccgcatctgaatcacgtntactgagcggctggcaaggcgcatagnnnnnn

SEQ ID NO: 103298 - DNA, 173 bp, Homo sapiens; identical to SEQ ID NO: 103286
  misc_feature: GYAE6OF01BGXQE.34.34.D01.1.454.CMB.1.raw
  modified_base (173)..(173): a, c, t, g, unknown or other
  misc_feature (173)..(173): n is a, c, g, or t

SEQ ID NO: 103299 - DNA, 495 bp, Homo sapiens
  misc_feature: GYAE6OF01DLKV3.34.34.D01.1.454.CMB.1.raw
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttgcctggtaccagcagaaacctggccaggctcccagacgtcctcatctatgctacatccacagggccactgctattccagccaggttcagtgcagtggtctgggacngagttcactctcaccatcagcagcctgcagtctgaagattcngctactttattactgtcagctagtctaatagtgccgtggacgttcggccgaagggaccgaaggtacggaaatcgaaacgactgtggctagcaccatctg

SEQ ID NO: 103300 - DNA, 514 bp, Homo sapiens
  misc_feature: GYAE6OF01AEKOI.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccacctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagtattctgtctactttattactgtacagcagtactaataggtggccgtggaccggttcggccgaagggaccgaagggtcggaaatacgaaacgacgtgtacggtctagaccaccagtcgtcg

SEQ ID NO: 103301 - DNA, 525 bp, Homo sapiens
  misc_feature: GYAE6OF01AFI0P.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgatgcgtccaacgacgggcccctggcatcccagacaggttcagtggcaggtgggtctgggacagacttcgactctcaccatccaccagacgtggacgccctagaagtattttgctagtgtattactgtacaactagttggtctcacactacgtcggtacgttcggacgaacgggaccgaaggtacggaaatacgaaacgaatggtcgcgtgctacatctctctctacg

SEQ ID NO: 103302 - DNA, 509 bp, Homo sapiens
  misc_feature: GYAE6OF01A410C.34.34.D01.1.454.CMB.1.raw
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtggcaggtgggtctgggacagagttcactctcaccatcagcagcctgctagtctagaagtattctgtcctacttttattactgtcagctagttactaagttagtggccgtggacgttcggacgaaggaccaagggtgaaancgaaacgactgnggctagaccacngtcgtc

SEQ ID NO: 103303 - DNA, 492 bp, Homo sapiens
  misc_feature: GYAE6OF01A73UB.34.34.D01.1.454.CMB.1.raw
  modified_base (203)..(203): a, c, t, g, unknown or other
  misc_feature (203)..(203): n is a, c, g, or t
  modified_base (475)..(475): a, c, t, g, unknown or other
  misc_feature (475)..(475): n is a, c, g, or t
tcagtacacgtgatcacgaccggtgctcgatttagatcgtctgtgttgggtttgggggaggaactgctcagttaggacccagacggaaccatggaaaccccagcgcagcttctcttcctcctgctactctggctcccagatgcccccggagaaatagtgatgacgcagtctccagccaccctgtctgtgtctccaggggaaanagccaccctctcctgcagggccagtcagagtgttggcagcaacttagcctggtaccagcagaaacctggccaggctccagagtcctcatctatgctacatccacaggccactgctatccagccaggtcagtgcagtggtctgggacaggattcactctcacatcagcagcctgcagtctgaacgtattctgctactttattactgtcagcagtactaagtagtgtccgtgacgttcggacaaggaccaaggtagaaacgtcgaaagacgtgngcagcacatctgtctac

SEQ ID NO: 103304 - DNA, 502 bp, Homo sapiens
  misc_feature: GYAE6OF01ANJDF.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagaattcactctcaccatcagcagcctgcagtctgaagtattttgctagtttattactgtcagcagtataataactggcctccggggacgttcggccaagggaccgaaggtggaattacaaacgaactgtggctgcaccatctgtc

SEQ ID NO: 103305 - DNA, 253 bp, Homo sapiens
  misc_feature: GYAE6OF01B3LTK.34.34.D01.1.454.CMB.1.raw
  modified_base (243)..(243): a, c, t, g, unknown or other
  misc_feature (243)..(243): n is a, c, g, or t
  modified_base (249)..(253): a, c, t, g, unknown or other
  misc_feature (249)..(253): n is a, c, g, or t
tcagtacacgtgatcacgaccggtgctcgatttagatcgtctgtgttgggtctgggacagagttcactctcaccatcaacagcctgcagtctgaagattctgcactttattactgtcagcagtctaataagtggccgtggacgttcggccaagggaccaaggtggaaatcaaacgaactgtggctgcaccatctgtctcatctcccgcatctgaatcacgtgtactgagcggctggcaaggcncatagnnnnn

SEQ ID NO: 103306 - DNA, 822 bp, Homo sapiens
  misc_feature: GYAE6OF01D18OB.34.34.D01.1.454.CMB.1.raw
  modified_base (207)..(207): a, c, t, g, unknown or other
  misc_feature (207)..(207): n is a, c, g, or t
tcagtacacgtgatcacgaccggtgctcgatttagatcgtctgtgttgggtttggggagaactgggctcagttaggacccagacggaaccatggaagccccagcgcagccttcgtcttcctcctgctactctggctcccagacaccgactggagaaataggtcgatgacgcagtctccagccaccctgtctgtgtctccagggaaanagccaccctctcctgcagggccctagtcagagtggttcggcaggcaacttagccgtggttaccagcagaacctggccaggctacccagacgtccctaccatctatcgacttacagtccaccgacgggtcccacgtcgcctaagttcccacgtcccgtaggtttacctacggtcggtccgtaaggtcggggttacctacgggggaactacggtacggttaccaaaccgttcccgttacccaaccctaacttaccgtaaccgtccgtaacggtcccccttaggtaccgtaacgggttaccgtaacggtaaaggttaacctttttacccgtacggttaccttaaacccgttttttaacttttaaccgtttaccggtttaacgtaacggtacccgtaacggttttaacccttaaaggtttaaccgggtttcggggttaccccgggttaggggtaacccgggttttacccgggaacccgggtaaaacggggtaaccccggtaaaacgggggttaaccgggtaaaaccgttaccggaaaaaacccgggtaacccggttagggttacccgggtaccgtttacccggacccgttaacccccgtaagtttccggtttaccccgg

SEQ ID NO: 103307 - DNA, 260 bp, Homo sapiens
  misc_feature: GYAE6OF01B0FCM.34.34.D01.1.454.CMB.1.raw
  modified_base (252)..(260): a, c, t, g, unknown or other
  misc_feature (252)..(260): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgtttcggccaagggaccaaggtggaaatcaaacgaactgtggctgcaccatctgtcttcatcttccgcatctgaatcacgtgtactgagcgggctggcaaggcgcatagnnnnnnnnn

SEQ ID NO: 103308 - DNA, 501 bp, Homo sapiens
  misc_feature: GYAE6OF01BGKAJ.34.34.D01.1.454.CMB.1.raw
  modified_base (496)..(496): a, c, t, g, unknown or other
  misc_feature (496)..(496): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctagaagtattctgctacttttatactgtcagctagtctaatagtggccgtggacgttcggacaagggaccaagggtgaaatcgaaacgtactggtggctgacacctntctcg

SEQ ID NO: 103309 - DNA, 635 bp, Homo sapiens
  misc_feature: GYAE6OF01BFUW2.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgtacgcagtctcctagccaccgtgtctgtgtctccaggggaaagagtcacccgtctcctggcagggccagccagagtcgttagcagcaacttggcctggtaccagcagaacctggaccaggcctccaggcctacctcatcctagtcggtcgcacgtcccgaacgcgggccacgtggtactccagccaggttcagtgcagtgggctaggacagtatcgactcgtcacatcagtcacgcctgacagtactagaagttattttacggcttaagttttataccgtttgtacgtactaagtaacgtaattaacgtaaccgtaccggtcccggtacccggggtaaccgttaccgggaccggtaaacgggtacccggtaaagggttaacggtaaacgttaaccgtaaaacgggtaccggttagggaccggtacgtacggtacccgtaaaccgtacgttacgttccggttaccgtttacccg

SEQ ID NO: 103310 - DNA, 554 bp, Homo sapiens
  misc_feature: GYAE6OF01DGXQH.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttgcctggtaccagcagaaacctggccaggctcccagagtcctcatctatgctacatccacgaggccactgctatccagccaggttcagtggcagtggtctgggacagagttcactctcacatcagcagcctgcagtctagaagtattctgtcttacttttattactgtcagtctagttactaaagttaggtcgggaccgttgggtaccggtttccgggaccgtaaaggggacccgtaaaggggtacgaaaagttacgaaaaccggtaacttgggtacggtctacggacctacctagttcgttaccgg

SEQ ID NO: 103311 - DNA, 532 bp, Homo sapiens
  misc_feature: GYAE6OF01A9562.34.34.D01.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggcctccagacgtcctcatctatgctacatccaccaggccactgctatccagccaggttcagtggctagtgggtctggacagagttcactctcaccntcagcagcctgcagtctagagtattctgctacttttatactgtcagctagtactaagtaagtcggtccgtaggacgttcggacctaaaggggaccctaagggtcggaaatccgaaaacggtaccgtggtacggacctacggacctaccgtagtcgttacg

SEQ ID NO: 103312 - DNA, 174 bp, Homo sapiens
  misc_feature: GYAE6OF01EKNRG.34.34.D01.1.454.CMB.1.raw
  modified_base (173)..(174): a, c, t, g, unknown or other
  misc_feature (173)..(174): n is a, c, g, or t
tcagtacacgtgatcacgaccggtgctcgatttagatcgtctgtgttgggtttgggggaagaggaagactgacggtcccccaggagttcaggtgctgggcacagcggccctgggctgcctggtcaaggactacttccatcacgtgtactgagcgggctggcaaggcgcatagnn

SEQ ID NO: 103313 - DNA, 503 bp, Homo sapiens
  misc_feature: GYAE6OF01EVNGQ.34.34.D01.1.454.CMB.1.raw
  modified_base (497)..(497): a, c, t, g, unknown or other
  misc_feature (497)..(497): n is a, c, g, or t
tcagtacacgtgatcacgaccggtgctcgatttagatcgtctgtgttggttttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctccccagagtcctcatctatgctacatccaccagggccactgctattccagccaggttcagtggcagtgggtctgggacagagttcactctcaccatcagcagcctgcagtctagaagattctgctactttattactgtcagcagtctaatagtggccgtggacgttcggaccaagggaccaagggtggaaatcgaaaacgactgtcggactgaccacntcgtag

SEQ ID NO: 103314 - DNA, 541 bp, Homo sapiens
  misc_feature: GYAE6OF01D5N40.34.34.D01.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcaagaaacctggccaggctcccagacgtcctcgatctatgctacactccaccgngggccactgctatccagccaggttcagtgcagtggtctgggacngtacgtcactctacaccatcagcagcctgcagtctagaacgtatttctgacttacttttattactgtacaggtctaggttacttaagtaaggtcggtccgtaggtaccgttcggaccgaaagggaccaaggggtacgtaaacacgaaaacgtaacgtggtacggctagaccacctagtcttacg

SEQ ID NO: 103315 - DNA, 503 bp, Homo sapiens
  misc_feature: GYAE6OF01A38OX.34.34.D01.1.454.CMB.1.raw
  modified_base (203)..(203): a, c, t, g, unknown or other
  misc_feature (203)..(203): n is a, c, g, or t
  modified_base (497)..(497): a, c, t, g, unknown or other
  misc_feature (497)..(497): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaacctggccaggctcccagagtcctcatctatgctacatccaccagggccactgctattccagccagttcagtggcagtgggtctgggacagagttcactctcaccatcagcagcctgcagtctagatattctgtctactttattactgtcagcagtactaatagtggccgtggtacgttcggaccgaagggaccaagggtcgtaaatcgaaacgacgtgtacgtctagacacntcgtcg

SEQ ID NO: 103316 - DNA, 586 bp, Homo sapiens
  misc_feature: GYAE6OF01EW0X0.34.34.D01.1.454.CMB.1.raw
  modified_base (356)..(356): a, c, t, g, unknown or other
  misc_feature (356)..(356): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagcgccaccctctcctgcagggccagtcagagtgttggcagcaacttagcctggtaccagcagaaacctggccaggctcccagagtcctcatctatgctacatccaccagggccactgctatccagccaggttcagtggcagtggtctggacagngttcactctcaccatcagcagcctgctagtctagaagtattctcgtactacttttattactgtacagtctaagtaccgttaaattaagggttcgggtccggttagggtacccggtttacgggacccggtaaaacgggggaacccgtaaaggggttacgggaaaaagttaccgtaaaaacgggtaccgttagggtacggtacggtacgaccaaccctagtccgtttaccgg

SEQ ID NO: 103317 - DNA, 532 bp, Homo sapiens
  misc_feature: GYAE6OF01CT4TV.34.34.D01.1.454.CMB.1.raw
  modified_base (202)..(202): a, c, t, g, unknown or other
  misc_feature (202)..(202): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtgtctccaggggaaangccacctctcctgcagggccagtcagagtgttggcagcaattagcctggtaccagcagaaacctggccaggctccagagtcctcatctatgctacatccacagggccactgctatccagccaggttcagtgctagtggtcngggtacagtagttcactctcacatcagcagcctgcagtctagaagtnttctgtctacttttattactgtcaagtcctagttactaaataaggtcggacccggttggtaccgttcgggacctaaagggacccaaagggtcgaaattacgaaaacgtaccgtaggtacggactagacacctgttccttacg

SEQ ID NO: 103318 - DNA, 538 bp, Homo sapiens
  misc_feature: GYAE6OF01B53MF.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctcccagacgtcctcatctatgctacactccaccagggccactgctattccagcctaggtcagtggcaggtgggtctgggacagtagttcactctcaccatcagcagcctgcagtctagaatattctgactactttacttactgtcagtctagttctaagtaggtcggaccggttggtaccgttcggaccgtaagggtaaccaagggtacggaaataccgaaaacggtacgtaggtcggtactacggaccacctagtcgtacg

SEQ ID NO: 103319 - DNA, 255 bp, Homo sapiens
  misc_feature: GYAE6OF01CB70R.34.34.D01.1.454.CMB.1.raw
  modified_base (250)..(255): a, c, t, g, unknown or other
  misc_feature (250)..(255): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatctcccgcatctgaatcacgtgtactgagcggctggcaaggcgcatagnnnnnn

SEQ ID NO: 103320 - DNA, 508 bp, Homo sapiens
  misc_feature: GYAE6OF01CHPKE.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggcctggcgcccaggctcctcatctatatgcctatagcagggccactggcgtccagacaggttcagtggcagtgggtctggggcagcttcactctcaccatcagcagactggagcctgaagtattttgctagtgtatttagttgtcagcagcatcagtcgtcaccgtactactttggccgtaggggacccaaggtcgtaggagagtacaaacgaacgtcggtagacgtcgcgccgtacg

SEQ ID NO: 103321 - DNA, 550 bp, Homo sapiens
  misc_feature: GYAE6OF01CT1RF.34.34.D01.1.454.CMB.1.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtgtctccgaggggaaanagccaccctctcctgcagggccagtcagagtgttggcagcaacttagcctggtaccagcagaaacctggccaggctacccagacgtcctcatctatcgctacatccaccagggccactgctatccagccaggttcagtggcaggtggtctggacngtagttcactctcacatcagcagcctgcagtctagaagtnttctgctacttttattcgtntactacggactacgttactaagtaacggtcggtaccgtggtacgttccggaccgaaacgggtaccgtaagggtacgtaaagtaccgtaaaacgtagttagggtacgtacgtgaacctaccgattccgttacg

SEQ ID NO: 103322 - DNA, 558 bp, Homo sapiens
  misc_feature: GYAE6OF01CQY7E.34.34.D01.1.454.CMB.1.raw
  modified_base (204)..(204): a, c, t, g, unknown or other
  misc_feature (204)..(204): n is a, c, g, or t
  modified_base (365)..(365): a, c, t, g, unknown or other
  misc_feature (365)..(365): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgtgcagcaacttagcctggtaccagcaagaaacctggaccaggcctaccagacgtcctcatctatgctacatccacaggccactgctatccagccaggttcagtggcagtggtctggacagagttcactcncacatcagcagcctgcagtctagaagtactttctcgacttaacttttagttaactgttacacgtactaggttaccttaaataacggtcggtaccgtgggtaccgttcggacccgtaaaggggaccctaaagggtacggtaaaatacgaaaaccggaacgtgggtacgtactaggaccaacctagttcttacgg

SEQ ID NO: 103323 - DNA, 498 bp, Homo sapiens
  misc_feature: GYAE6OF01BP1ZK.34.34.D01.1.454.CMB.1.raw
  modified_base (400)..(400): a, c, t, g, unknown or other
  misc_feature (400)..(400): n is a, c, g, or t
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctccagagtcctcatctatgctacatccaccagggccactgctattccagccaggttcagtggcagtgggtctgggacagagttcactctcaccatcagcagccctgcagtctgaagtattcngctacttttatactgtcagcagtctaatagtggccgtggacgttcggaccaagggaccgaaggtgaaatcgaaacgatgnggctgacaccntcgtacg

SEQ ID NO: 103324 - DNA, 604 bp, Homo sapiens
  misc_feature: GYAE6OF01AWG3F.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcaacgaaacctggaccaggcctacccagacgtcctacatctatgcctacactcccaccgagggccactcgacttacttccagcctaggttcaggtcggctaggtcgggtcgtgggacagtacgttccactctacacatcagcacgctgcagtctagaagtcttcgtgtacttacttttatacttgtcagtactagttaactaagttaacggtcgggtccgttagggaccggttaccgggaccgtaaacggggtacccgaaaggggttaacggaaaacttacggaaaaaccggtaacgttgggtacgggtaccttacggaacccaaccgttagttccgttacgg

SEQ ID NO: 103325 - DNA, 522 bp, Homo sapiens
  misc_feature: GYAE6OF01C3ZPL.34.34.D01.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
  modified_base (515)..(515): a, c, t, g, unknown or other
  misc_feature (515)..(515): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggaccaggctcccagacgtcctcatctatcgctacactccacgagggccactgctatccagcctaggttcagtggctaggtgggtctgggacagtacgttcactctcacatcagcagcctgcagtctagaagtnttctgtcttacttttatactgtcagctagtataagtaggtcgtcgtggtacgttcggaccgaagggtaccaagggtacgaaatacgaaacgtacgtggagtctacgacaccngtctacg

SEQ ID NO: 103326 - DNA, 752 bp, Homo sapiens
  misc_feature: GYAE6OF01CH92P.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagcgccaccctctcctgcagggccagtcagagtgttggcagcaacttagcctggtaccagcagaaacctggaccaggcctccagacgtcctcatctatcgcctacactccaccgacgggcccactcgacttacttcccaagtccccgtaggtttccaagggttcgggaccgttagggtcggggttaccgtaggggaaccgtaggtacggtttcccaaccgttccgtacctaacccctaattacccgaagaccgtacggtccccgttggaccgttacggtccttaaggaacgttacgtttccgtacgtacctttaacttttaacgtttacgtcgttacgaacgttaccgtaacgtttaaccgttaaacgttaagggttaccggggttacccgggttacgggtaacccgggtttaccggggaaacccggtaaaccgggggtaaacccgtaaacggggtaacgggtaaaacgttaaccggaaaaaccggttacggttaccgggtaggtaacccgttacggaacccgttaaccgtaacgtttcccggtttaccg

SEQ ID NO: 103327 - DNA, 577 bp, Homo sapiens
  misc_feature: GYAE6OF01BHA77.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaagagccaccctctcctgcagggccagtcagagtgttggcagcaacttagcctggtaccagcaacgaaacctggccaggcctaccgagacgtcctcatctatcgcctacactccaccgacggccactgctactccagcctaaggttccaggtggctaggtcgggtactgggactaggacgttcgactctacactatcagcacgctgactagtcagaacgtattcagtcttactttattcagtcagctagttactaaagtacggtcggcgtacggtacggttacggaaccgtaacgggtaacccgtaaggggtacgtaaacaccggtaaaacggtaccgtagggtacggtcgtacgaccctaacctagttccgttacg

SEQ ID NO: 103328 - DNA, 573 bp, Homo sapiens
  misc_feature: GYAE6OF01BUMSG.34.34.D01.1.454.CMB.1.raw
  modified_base (202)..(202): a, c, t, g, unknown or other
  misc_feature (202)..(202): n is a, c, g, or t
  modified_base (414)..(414): a, c, t, g, unknown or other
  misc_feature (414)..(414): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaanagccaccctctcctgcagggccagtcagagtgttggcagcaacttagcctggtaccagcagaaacctggccaggcctcccagacgtcctcatctatgctacatccaccgacgggcccactgctacttccacgccaggttcagtggcaggtgggtctgggacagagttcactctcaccatcagcacgccctgcctagtctagaagtatttcgngtacctacttttattacctgtacagtactaggttacttaagtaaggttcgggtaccggtaggtaccggttcgggaccgtaaaggggacctaaaggggtcggaaataccggaaaacggtacgttgggtacggcgttacgacctaccgtagttccgttacg

SEQ ID NO: 103329 - DNA, 816 bp, Homo sapiens
  misc_feature: GYAE6OF01B4919.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgttggcagcaacttagcctggtaccagcagaaacctggccaggcctccagacgtcctcatctatcgacctacactccaccgacgggcccaacgtcgccttaacttcccgagtccctaaggtttccaagggttcgggaccgtagggtcggggtcgtagggggtaacaaggtaaactttccgaaccttccttacccgaaccctagttaccgaacggcctaacggtccccttaggacctaacgggtttacctaagggtaaaacggttcttttaccgtacggttaccttttaaacccttttttaagttttacccgttaggtttaccgaaacggtttacccgttaaacggtttaaccgttttaaaagttaaccggggtttcggggttaaccccggtttaggggggtaaaccccggttttaccgggggaaccccggtaaaaccgggggtaacccggtaaaacgggggtttaacgggtaaaaaacccgttaacccggtaaaaaacccggggttaacgtttacgggggtaccgggtaacccgttaccgggtaaccctaaccccggttagtttaccccgggttttacccg

SEQ ID NO: 103330 - DNA, 531 bp, Homo sapiens
  misc_feature: GYAE6OF01ETWGD.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagcccaccctctcctgcagggccagtcagagtgttggcagcaacttagcctggtaccagcagaaacctggccaggctcccagacgtcctcatctatgctacactccaccgaggccactgctatccagccaggttcagtggcaggtgggtctgggacaggagttcactctacaccatcagcagcctgcagtctagaagtattctgctactttattactgtcagctagtactaagtagtcggccgtggtacgttcggaccgtaacgggaaccgtaagggtaggaaatacgaaacggaacgtggtacggtactagaccactagtcgtacg

SEQ ID NO: 103331 - DNA, 516 bp, Homo sapiens
  misc_feature: GYAE6OF01D1TDV.34.34.D01.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
  modified_base (509)..(509): a, c, t, g, unknown or other
  misc_feature (509)..(509): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagacgtcctcatctatcgctacactccaccgagggccactgctatccagccaggttcagtggcaggtgggtctgggacaggtagttcactctcaccatcagcagcctgcagtctgaagtnttctgctactttatctgcagcagtactaataggtcggcgtggtaccgttcggacgaagggaccaagggtacgaaatcgaaaacgacgtggacggtctagaccaactntcgtacg

SEQ ID NO: 103332 - DNA, 705 bp, Homo sapiens
  misc_feature: GYAE6OF01CULAW.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgcccaccctctcctgcgaggccagtcagagtgttggcagctattagcctggtaccagcagaaacctggccaggcctccagacgtcctcatcctatgacctacactcccaaccgacgggccctactcgcttacttcccagcctaggttcgagtggcgtaggtcgggtcgtggggactaggtagtttccacgttccgtacctaccgaatccacgccgacgtccgtagccgtagtccgtagaacgtctttcgtgtaccttaacttttacttacttcgtacgaacgtacgtaacgtttaacctaaaggttacgggttccgggtacccgggttacgggttaacccgggtttacccgggaaacccgggtaaacggggggtaaaccccgtaaaggggggtttaaaccgggtaaaaaccgttaacccgggtaaaaaacgggttaaccgttaggggttaccggtaccggttaccggaacccgttaacccgtacgtttaccgttaccgg

SEQ ID NO: 103333 - DNA, 192 bp, Homo sapiens
  misc_feature: GYAE6OF01EGF1Z.34.34.D01.1.454.CMB.1.raw
  modified_base (171)..(192): a, c, t, g, unknown or other
  misc_feature (171)..(192): n is a, c, g, or t
tcagtacacgtgatcacgaccggtgctcgatttagatcgtctgtgttgggttgggggaagaggaagactgacggtcccccaggagttcaggtgctgggcacagcggcctgggctgcctggtcaaggactacttccatcacgtgtactgagcgggctggcaaggcgcatagnnnnnnnnnnnnnnnnnnnnnn

SEQ ID NO: 103334 - DNA, 601 bp, Homo sapiens
  misc_feature: GYAE6OF01CAELY.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagcgccaccctctcctgcagggccagtcagagtgttggcagcacttagcctggtaccagcagaacctggccaggctacccagacgtcctcatctatgactacactccacgaggcccagtcgactattcccaagactaggttcaggtcgggctaggtgggtcagggactaggtaccttcacttcaccaccactacagacagtacttgacgtcctagtaagtacgttttagactaagttattatttacgtgtacagtactaattacgtacgtacgtaccgtacgtacgtgggtcgggtccggttaccgggaccggtaaacggggaccgtaaaggggtaggtaaacgtaccggaaaacggtaacggtacggtacggacgtacgaccctaccgtacgttaccg

SEQ ID NO: 103335 - DNA, 174 bp, Homo sapiens; identical to SEQ ID NO: 103312
  misc_feature: GYAE6OF01EPX9A.34.34.D01.1.454.CMB.1.raw
  modified_base (173)..(174): a, c, t, g, unknown or other
  misc_feature (173)..(174): n is a, c, g, or t

SEQ ID NO: 103336 - DNA, 531 bp, Homo sapiens
  misc_feature: GYAE6OF01CKRO4.34.34.D01.1.454.CMB.1.raw
  modified_base (204)..(204): a, c, t, g, unknown or other
  misc_feature (204)..(204): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (523)..(523): a, c, t, g, unknown or other
  misc_feature (523)..(523): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagngccaccctctcctgcagggccagtcagagtgttggcagcaacttagcctggtaccagcagaaaacctggccaggctcccagacgtcctcatctatgctacatccaccagggccactgctattccagccaggttcagtggcaggtggtctgggacagagttcactctacaccatcagcagcctgcagtctgaanattcngtactactttattactgtcagtctagtactaagtaacgtggaccgtggtaccgttcggaccgaacgggaccaaagggtcggaaatacgaaaacgacgttggacggtctacggacaaccgtntccgttcg

SEQ ID NO: 103337 - DNA, 491 bp, Homo sapiens
  misc_feature: GYAE6OF01A7GKH.34.34.D01.1.454.CMB.1.raw
  modified_base (203)..(203): a, c, t, g, unknown or other
  misc_feature (203)..(203): n is a, c, g, or t
  modified_base (486)..(486): a, c, t, g, unknown or other
  misc_feature (486)..(486): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagattctgctactttattactgtcagcagtctaatagtggccgtggacgttcggccaagggaccaaggtgaatcgaaacgactgtggctgcacntctcg

SEQ ID NO: 103338 - DNA, 508 bp, Homo sapiens
  misc_feature: GYAE6OF01D5BB2.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctcccagagtcctcatctatgctacatccaccagggccactgctatccagccaggttcagtggcagtgggtctgggacagagttcactctacaccatcagcagcctgcagtctagatattctgctactttattactgtcagctagtactaagtaagtggccgtggacgttcggaccgaagggaccaagggtcgaaatacgaaacgacgtgtacggctaggacactatcgtcg

SEQ ID NO: 103339 - DNA, 941 bp, Homo sapiens
  misc_feature: GYAE6OF01EQDO3.34.34.D01.1.454.CMB.1.raw
tcagtacacgtgatcacgaccggtgctcgattttagatcgtctgtgttgggtttgggggacggaactagctcagttaggacccagacggaaccgatggaagccccgagcgcgagcttctcttcctcctgtctactctggctcccagtacaccacgtggagaaagtagtgatgacgcagtcgtccagccaccctgtcctgggtcgtcgtccgaaggggaaactacgccgaccctctccgtgcgtaggggccctagtccagaggttgttcggcctaggctaacttaggccgttgggtaacccagacgaacggtaaaacccgtgggacccgaggtcctacccgaggtacgttccctacgtaagtttaccgttaagtcggaccttaacgacgttacccgaaccgaacggggtacccctaacgttacggacccgtttaactttccccggaacggtacccggttaacgggtttaccaacgggttacggtaccgtaggggtttaccggggttaccgtacgggggtaaacctaaacgggttaacgtttaaccgaaaccgtttacccgttacccgtaacccgttaagttacccggaaacggtaccgtaaacgggtaccccgttaacgggtaccgttaacgggtttaccgtaaacgggaaacggtttaccggttttacccggtaacggttaaccctttaaccgtttttttaacgttaaccgtttcggttaaccgaacggttacttaaacggtttaacgtttaaaagttaacgggttccgggtacccgggttaaggggtaacccggtttacccgggaaacccgttaaacggggggtaaccccgtaaagggggttaaccggtaaaacgttacccgggaaaaaccggttaccggttacgggtaccgggtacccgttaccggaacccgttaacccgttacgttcccgttacccgg

SEQ ID NO: 103340 - DNA, 518 bp, Homo sapiens
  misc_feature: GYAE6OF01CWTFX.34.34.D01.1.454.CMB.1.raw
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagctggtaccagcagaaacctggccaggctccagngtcctnatctatgctacatccacaggccactggcactcccagacaggttcagtgcaggtggtctggacngactcactctcacatcagcagtactgagcctagagtatttgactagtattattactgtacagactaatatacgagacgactacgtggtcgggtcgttcggaccgtaagggaccgtaagggtagaaacgtacgaaacgacgtaggtacggactagaccacgtattacg

SEQ ID NO: 103341 - DNA, 580 bp, Homo sapiens
  misc_feature: GYAE6OF01CJ7XB.34.34.D01.1.454.CMB.1.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
  modified_base (565)..(565): a, c, t, g, unknown or other
  misc_feature (565)..(565): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctcgaggggaaanagccacctctcctgcagggccagtcagagtgttggcagcaacttagcctggtaccagcagaacctggaccacgccctccagacctccgtactagtttaactggtcgactaagtacctacggacgggcccctgggacactcccagacgtaggttcagtggctagggtcgggtctgggacagtacttcgactctcaccatccacgagacgtggacncgtagtaagtatttgctagttgttacttacgtacgtactaacgtagttcgtctacacaccgtacggtaggtaccgttacggaccgtagggaaccgtaagggtagaaacgtacgaaacgtacgtggtacggctcggacaccgtcgtactntaccttctcttcccg

SEQ ID NO: 103342 - DNA, 516 bp, Homo sapiens
  misc_feature: GYAE6OF01DKR9K.34.34.D01.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (510)..(510): a, c, t, g, unknown or other
  misc_feature (510)..(510): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangcccaccctctcctgcagggccagtcagagtgttggcagcaacttagcctggtaccagcagaaacctggccaggctcccagacgtcctnatctatgctacatccaccgacgggccactgctactccagcctaggttcagtggcaggtggtctgggacngtagttcactctcacatcagcagctgcagtctgaagtnttcngtctactttatctgtcagctagtntaagtagtcggcgtaggacggttcggaccgaaacgggaccaaagggtgaaatacgaaacggactggacggtcctagaccaccntcgtcg

SEQ ID NO: 103343 - DNA, 587 bp, Homo sapiens
  misc_feature: GYAE6OF01DGXAN.34.34.D01.1.454.CMB.1.raw
  modified_base (445)..(445): a, c, t, g, unknown or other
  misc_feature (445)..(445): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgagggaaagcgcccaccctctcctgcgagggccagtcagagtgttggcagacaacgttagcctaggtactagcaagaaacctggaccaggcctcccgagacgtcctcatctatcgctacactcccacgacgggcctactcgctacttccagacctaggttcaggttcggcgtagggttgggtcgtaggggaactaggtacgttccaccttcgtaccacctatcacgcacgccctgcgtagtcgagtaagtnttccgtagtacttacttttactactgtacagtactagttactaagtacggtcggtaccgtggtaccggttaccggacgaacgggacgtaagggtaacgaaactacgaaacgtagtggagtctacgacctaactgttcgttcg

SEQ ID NO: 103344 - DNA, 650 bp, Homo sapiens
  misc_feature: GYAE6OF01D2MDN.34.34.D01.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (288)..(288): a, c, t, g, unknown or other
  misc_feature (288)..(288): n is a, c, g, or t
  modified_base (480)..(480): a, c, t, g, unknown or other
  misc_feature (480)..(480): n is a, c, g, or t
tcagtacacgtgatcacgaccggtgctcgatttagatcgtctgtgttgggcttgggggaggaactgctcagttaggacccagacggaaccatggaagccccagcgcagcttctcttcctcctgctactctggctcccagcaccactggagaaatagtgatgacgcagtctccagccaccctgtctgtgtctccaggggaaanacgccaccctctcctgcaggccagtcagngtgtggcagcaacttagcctggtaccagcagaacctggccagctcccagacttcctnatctatcgacctacactccgaccgaggccactgtacctacttcccgagtaccgtaggttcgaaggttcggacgtagggttcgggtacgtagggtaacaacggttacgtttccaacctccgtaccgtaacctaacgtaccacgtacctacgtccgttaacgacgtaacgttccgtagtaacgttacttccgtncctacgtttactttacttcgtacgtacgtacgtaagtacgtaacgttaacggtacggtaccgggtacggtaccggttaccggtaaccggtaacgggaaaccgtaacggtaaggtaaacgtacgtaaacgtaacgtacggtacggtacgtacgtaccgtaccgtacgtacg

SEQ ID NO: 103345 - DNA, 616 bp, Homo sapiens
  misc_feature: GYAE6OF01DL5TZ.34.34.D01.1.454.CMB.1.raw
  modified_base (211)..(211): a, c, t, g, unknown or other
  misc_feature (211)..(211): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
tcagtacacgtgatcacgaccggtgctcgatttagatcgtctgtggttggggtttgggggaggaactgctcagttaggacccagacggaaccatggaacgccccagcgcagcttctcttcctcctgctactctggctcccagacaccactggagaaatagtgatgaccgcagtctccagtcccaccctgtctgtcgtctccgaggggaaancgccaccctctcctgcagggccagtcagagtgttggcagcaacttagcctggtaccagcaagaaacctggaccaggcctcccgagacgtcctcatctatcgactacactccaccacgggcctactgtcctatccgagtccgtaggttcaggtgctaggtcggtcgngggacagacttcactcgcaacctntccagccagcctgactagtcgtagaagtattccagtacttaacgttttactacgtcgtacgagtacgtagttactaagttaacggtcgggtaccggttgggaacccggtttcggaacccggaaacgggtaacccgtaaaggggtaacggtaaaactaccgtaaaaaccgggtacgttggtacgggtaccttaggaccctaacctgttcgttaccg

SEQ ID NO: 103346 - DNA, 600 bp, Homo sapiens
  misc_feature: GYAE6OF01DJU5V.34.34.D01.1.454.CMB.1.raw
  modified_base (374)..(374): a, c, t, g, unknown or other
  misc_feature (374)..(374): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagacgccaccctctcctgcagggccagtcagagtgtggcagcaacttagcctggaccagcaagaaacctggccaggctccgagacgtcctacatctatcgctacactacccaccgacggccctactgactacttccagccgtaggttacaggttggcgtagggtcgggtcgnggggaacagtacgttccactcactaccagtacaggctacgtcctgcgtagtctagaagtctttcagtacttacttttatacgtgtcagtctacggttacttaaagtacgggtcggtaccgtacgggtacgttaccggaccgaaacggggaccgtaaaggggtacgtaaaagtaccgtaaaacggtaacgtcgggtacggtacgtaacgacctaacctgttcgttcg

SEQ ID NO: 103347 - DNA, 560 bp, Homo sapiens
  misc_feature: GYAE6OF01DG2R9.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccagggggaaangccaccctctcctgcagggccagtcagagtgtggcagcaacttgcctggtaccagcagaaacctggccaggcctcccagacgtcctcatctatgctacatccacagggccactgctatccagccaggttcaggtgcaggtgggtctgggacaggtacgttcactctacaccatcagcagcctgctagtctagaagtattctgctacttttattacctgtcaagtctaggttactaagttaggtcggtaccgttaggtaccgttccgggaaccgtaaacggggacgtaaagggttacggaaaattacggaaaacgtaacgtggtacggtcgtacggacctaacctgttccgtttacg

SEQ ID NO: 103348 - DNA, 567 bp, Homo sapiens
  misc_feature: GYAE6OF01DCCVD.34.34.D01.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctcccagagtcctnatctatcgctacatccacagggccactgctatccagccaggttcagtgcagtggtcngggacagtgttcactctcacatcagcagcctgcagtcngagnttcngctacttttatactgtcagtctagttacttaagtaggtcggtacccggttgggtaccgtttccgggaccgtaaacgggggtacccgtaaaaggggttacggaaaacgttaccgaaaaaccggtaccgttaggtacgggtaccttacgggaccctaacccgtagttccgttacgg

SEQ ID NO: 103349 - DNA, 527 bp, Homo sapiens
  misc_feature: GYAE6OF01CCHD2.34.34.D01.1.454.CMB.1.raw
  modified_base (204)..(204): a, c, t, g, unknown or other
  misc_feature (204)..(204): n is a, c, g, or t
  modified_base (519)..(519): a, c, t, g, unknown or other
  misc_feature (519)..(519): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccagggggaaangccacctctcctgcagggccagtcagagtgttggcagcaattgcctggtaccagcagaaacctggccaggcctcccagagtcctcatctatgctacatccaccagggcccactgctattccagccaggttcagtggcaggtggtctgggacagagttcactctacaccatcagccagcctgcagtctagaagtattctgctacttttatactgtcagctaagtcttaaagtaggtcggaccgtggaccgtttcggaccgtaaggggacctaagggtacgaaattcgaaaacgtacgtggtacggactgaccactntcgttacg

SEQ ID NO: 103350 - DNA, 535 bp, Homo sapiens
  misc_feature: GYAE6OF01EGAQE.34.34.D01.1.454.CMB.1.raw
  modified_base (204)..(204): a, c, t, g, unknown or other
  misc_feature (204)..(204): n is a, c, g, or t
  modified_base (416)..(416): a, c, t, g, unknown or other
  misc_feature (416)..(416): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcgagggccagtcagagtgtggcagcaacttgcctggtaccagcagaacctggaccaggcctcccagacgtcctcatctatcgcctacactccaccgagggcccactcgctattccagcctaaggttcaggtcggacgaggtgggtcgtgggacaggtacgttcactctacacatcacgcacgctgctagtctagatnttcgagtcttactttatactgtacagtctagtactaagtacggtcgcggtggacgttcggaacgagggacgtaaggtacgaatacgaaacgacgtggtacgtctacgacactgtcgtcg

SEQ ID NO: 103351 - DNA, 603 bp, Homo sapiens
  misc_feature: GYAE6OF01A76RG.34.34.D01.1.454.CMB.1.raw
  modified_base (232)..(232): a, c, t, g, unknown or other
  misc_feature (232)..(232): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaagacgccaccctctcctgcagggccagtcagngtgttggcagcaacttagcctggtaccagcagaaacctggccaggcctccagacgtcctcactctatgctacactccaccagggccactgctattccagccaggttcagtggcaggtcgggtctgggacngacttcacgtcncaccatccagcagctgcagtcaggaagtcttcgtacgtacttactttagttacttgtacctagtacctaggttacttaaagttacggttcgggacccggttaggggtaacccgtttccgggaacccggtaaaccgggggtaaccgtaaaggggtaacggtaaaacgttaccggaaaaacggtacgttacggtacgggtacctacggaccctaaccgtacgtcgttaccg

SEQ ID NO: 103352 - DNA, 518 bp, Homo sapiens
  misc_feature: GYAE6OF01D7SRY.34.34.D01.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (508)..(508): a, c, t, g, unknown or other
  misc_feature (508)..(508): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagacgtcctcatctatgctacnctccaccagggccactgctattccagccaggttcagtggcagtgggtctgggacagngttcactctcaccatcagcagcctgcagtctgaanttcngctactttnttacngtcagcagttctaatagtgccgtaggaccgttcggaccaaagggaccaagggtcgaaaatcgaaaacgtacgtggtcggacttacggacacccngtccgttacg

SEQ ID NO: 103353 - DNA, 257 bp, Homo sapiens
  misc_feature: GYAE6OF01CPVM8.34.34.D01.1.454.CMB.1.raw
  modified_base (255)..(257): a, c, t, g, unknown or other
  misc_feature (255)..(257): n is a, c, g, or t
tcagtacacgtgatcacgaccggtgctcgatttagatcgtctgtgttgggtctgggacagagttcactctcaccatcaacagcctgcagtctgaagattctgcacttttattactgtcagcagtctaataagtggccgtggacgttcggccaagggaccaaggtggaaatcaaaacgactgtggctgcaccatctgtcttcatccttcccgcatctgaatcacgtgtactgagcgggctggacaaggcgcatagnnn

SEQ ID NO: 103354 - DNA, 590 bp, Homo sapiens
  misc_feature: GYAE6OF01DMUQD.34.34.D01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (582)..(582): a, c, t, g, unknown or other
  misc_feature (582)..(582): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatgtgatgacgcagtctccagccaccctgtctgtgtctccgagggaaangccaccctcncctgcagggccagtcagagtgttggcagcaacttagctggtaccagcaagaaacctggaccaggctcccagacgtcctcaatctatcgcctacgactcccacgagggccctactgacctattcccagtccctaggttcaggtcggctaggtgggtcctaggggactaggtagtttccaccgtcgtaccacctatcgaaggccagcccttgctaacgtcgtagaacgtatttccacgtcttaacttttacttaacgtgtacacgtacctagtactaaatagggttcggaccgttgggtaccttcggacgtaaacgggactaagggtacgaaataccgaaacggtactaggtcgtactacggactaccggtnttcgtacg

SEQ ID NO: 103355 - DNA, 650 bp, Homo sapiens
  misc_feature: GYAE6OF01B5FM3.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctccagacgtcctcatctatgctacatcccacacgggccactgctacttccagcctaggttccagtggcaggtcgggtctggggacacggtagtttcacgttccttaccaacctatccgaagccgagtccctggcctagtctagaacgtactttctgtaccttaacgttttattaaccttcgttactacggacttaacgttacgttaaagtaacggttcgggtaccggttacgggtaaccggtttaccgggaacccggtaaagggggtaacccgtaaaaggggttacgggtaaaacgttaaccggaaaaaccggtaaccgttagggttaccgggtaccgttcggaaccctacccgtaacgttcccgtttaccgg

SEQ ID NO: 103356 - DNA, 495 bp, Homo sapiens
  misc_feature: GYAE6OF01A3IJ6.34.34.D01.1.454.CMB.1.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
  modified_base (490)..(490): a, c, t, g, unknown or other
  misc_feature (490)..(490): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagattcngtctactttattactgtcagctagtctaatagtgccgtggacgttcggccaagggaccgaaggtgaatacgaaacgactgtggctgacacntctcg

SEQ ID NO: 103357 - DNA, 630 bp, Homo sapiens
  misc_feature: GYAE6OF01BOIOE.34.34.D01.1.454.CMB.1.raw
  modified_base (294)..(294): a, c, t, g, unknown or other
  misc_feature (294)..(294): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtcgtctccgaggggaaagcgcccaccctctcctgcagggccagtcagagtgtggcagctaactagcctggtaccagcaagaacctggaccaggcctaccagactccncatctatcgctacactccaccgacggccactgcctatcccgagtccgtaggttccaggtcggcagggtcgggtacgtagggactagtacgttcaccgtctacacctatcagccacgtcctgactagtcgtagaagttcttccgtgtactttaacgttttacttacgtcgttacgaagtaccttaacgttaaccgttaaaggttacgggttacggtaccgggttacggtaacccggttaccgggaaccgtaaacggggtaaccgtaaaggggtacgtaaaacgtaccggaaaaccggtagttcggacggtactacggacctaaccgtgtccgttacg

SEQ ID NO: 103358 - DNA, 550 bp, Homo sapiens
  misc_feature: GYAE6OF01DLWAW.34.34.D01.1.454.CMB.1.raw
  modified_base (397)..(397): a, c, t, g, unknown or other
  misc_feature (397)..(397): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctccagacgtcctcatctatggtgcatccacagggccactggtactcccaggcaggttcagtggcaggtgggtctgggacagagttcactctcaccatcagcagtctgcagtctgaagtntttgactagtttattacgtgtcagtctaactaataagtaagtcgaccttacgtaattccaacccgttcggaccgaaacggggaccacggtaccgtagggaacgtaacgttaaaaccgacgttacggtacggactaggacctaccgagttaccg

SEQ ID NO: 103359 - DNA, 605 bp, Homo sapiens
  misc_feature: GYAE6OF01D59X4.34.34.D01.1.454.CMB.1.raw
  modified_base (396)..(396): a, c, t, g, unknown or other
  misc_feature (396)..(396): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagacgtcctcatctatgctacatccaccagggccactgctatccagccaggttcagtggcagtgggtctgggacagagttcactctcacatcagcagctgctagtctagaagtnttcgtgtctacttttattactgtacagtactagttacgtaaagttacggttcgggtcccggttagggtaaccggtttaccgggacccgtaaacggggggtaaccccgtaaaggggttaacgggtaaaaacgttacccggaaaaacgggttaaccgttaggggttacgggtacgttacggaacccgtaaacccctgttaccgtttaccgg

SEQ ID NO: 103360 - DNA, 740 bp, Homo sapiens
  misc_feature: GYAE6OF01DANP6.34.34.D01.1.454.CMB.1.raw
  modified_base (534)..(534): a, c, t, g, unknown or other
  misc_feature (534)..(534): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagcgccaccctctcctgcgagggccagtcagagtgtgcagcacttagcctaggtaccagacaacgaaaccgtggaccaacggcctaccccgaagacgttacccctctaacttcctatcggtaccttaaccaaccttaccccgaacccggacgggtacccctactcggtacctaactttcccaacggtacccgtaggttttcccgaagggttcggaccgttaaggggttcgggttaccgtaggggaaccgtaggttacggttacccactttaccgaccgaaccctagtccgaacgaccgaagtccctggtacctagttacctaggaaacgttntttccgacgtactttaacgtttttataccgtggtacacgtaccgtaaggttaaccttaaaggtacggtcgggttacccgggttagggtaccggtttccgggaacccgtaaacggggtaaccgtaaaggggttaacgaaaacgttaccggaaaaccggttacggtggtaccggtactacgggaaccctaaccgtagttgtttaaccg

SEQ ID NO: 103361 - DNA, 735 bp, Homo sapiens
  misc_feature: GYAE6OF01BFWLO.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggagaaatagtgatgacgcagtctccagccaccctgtctgtcgtctccgagggaagcgccacctctcctgcacggccagtcagtagtgttggcagcaacttagccgtggtaccagacaacgaacctggaccaggcctacccgagacgtcctacattctatcgacctacactcccaaccgacgggacccctacgtcgtaccgttacttacccgacggtacccgtaaggtttccaagggttcgggcgtacggggttcgggtaccggtaggggaacctagggttaacgttcctaccttacctacccgtaaccgtacttaccgacggtacccgtaaccggtcccttaaggccgttaacggtaccgtaaggtaaaccgttcgttttacgtacggtacctttaacgttttaacttcgttacgttacgaacgtaccgttaagttaccgttaaagttaacggtcgggtaccgtagggtaccggttaccggacgtaaaccggggtaccgtaaaggggtacgtaaacgttaacccgaaaacggttccgtaagggttacccggtaccgtaacggacccaacgttacggttcgttacccg

SEQ ID NO: 103362 - DNA, 763 bp, Homo sapiens
  misc_feature: GYAE6OF01CY6UI.34.34.D01.1.454.CMB.1.raw
tcagtacacgtgatcacgaccggtgctcgatttagatcgtctgtggtttggggtttgggggaggaactgctcagttacggacccagacggaaccatggaagccccagcgcagcttctcttcctcctgctactctggctcccagacaccactggagaaatagtgatgacgcagtctccagccaccctgtctgtgtctccgaggggaaagcgcccaccctctcctgcagggccagtcagagtgttgcagcaacttacgctcggtaccagccgaagtaaacctggaccaggccctacccgaagccgtcccctactacttcctaagtcgacctaccactcccgtaaccgacgggtcccactgtccttaacttcccgaggtaccgtaggtttccgaaggttcgggacgtgggtacggggttacgaggggtaactacgttacttccgaacctccgtacctaccgaacgtccgaacggtaccgacggtacccgtaggtaccgttaacggttacgttacggaacgtttactttccgttaccgtaccgtttaactttttaactttacgtacgtttaaccgaacgttaccgtaacggtttaacccgttaaaggtaaccggggtttccggacccgggttacgggttaaccgggtttacccgggaaacgggtaaaacgggtacggtaaaacgggtaaaccggtaaagttaaccggtaaaaccggtacgttccgggtacggtacctaacggtcaacccggttattcggttaacccg

SEQ ID NO: 103363 - DNA, 759 bp, Homo sapiens
  misc_feature: GYAE6OF01CDTFX.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtcctcgaggggaaancgccaccctctcctgcgagggccagtcagagtgtggcagcaacttgcctggtaccagcaagaaccctggacccaggtcctacccgagtacgtcctacatcgtatcgactaaccactcccaaccggacgggcccctaacgtcgtaccttaacgttcccgaacggtcccgtaaggtttccgaacgggttcggggacctaagggggtttcggggtaccgttagggggaaactacgggttaaccgtttccaaaccgtttccttacccaacccgtaagttacccgaaacggtcccaacggtccccgttcggtaaccctaaggttcccgtaagggtaaacttacgttttccgacgtacctttaaaccgtttttataaccgttgttaccaagttccgtaagttacgttaaaggtaacggttcgggtaccggttagggtaacccggttacggggaacccgtaaaacggggtaaccggtaaagggttaacggaaaaccttaaaccggaaaaccggttaacggttggggtacgaccgttacgaacccgaaacttgtccgtttacg

SEQ ID NO: 103364 - DNA, 601 bp, Homo sapiens
  misc_feature: GYAE6OF01BNANH.34.34.D01.1.454.CMB.1.raw
  modified_base (204)..(204): a, c, t, g, unknown or other
  misc_feature (204)..(204): n is a, c, g, or t
  modified_base (438)..(438): a, c, t, g, unknown or other
  misc_feature (438)..(438): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatactactggagaaatagtgatgacgcagtctccagccaccctgtctgtcgtcccgaggggaaangccatcctctcctgcagggccagtcagagtatagcaccaacttagcctggtaccagcaagaacctggccagacctccaggcctcctcactctagtcggtgctatcccaccgacgggccacgtcggtactcccgaggcgaggttcaggtggacgtagggtgggtcgtggggactaggtacgttccacgttctaccacctatacagtctagtccgtgacgtagtctagtaacgttnttttgactttagtttacttactgtactagtactaattaattaacgttacgtcggtacctaccgtactccgtaccgtccggaacgaacgggacaacggtacggtacggtaagtaacgttaaaccggacgttacgacggtactacggacctacgtattcgttacg

SEQ ID NO: 103365 - DNA, 579 bp, Homo sapiens
  misc_feature: GYAE6OF01AO59R.34.34.D01.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (542)..(542): a, c, t, g, unknown or other
  misc_feature (542)..(542): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgttggcagcaacttagcctggtaccagcagaacctggaccaggcctcccagacgtcctcatctatcgcctacnctccaccgacgggcccactcgccttaacttcccgaacggcccgtaggtttccagggtgggccgaggttcggggtctaggggactaggtacgtttccaccgttctaccacctatcagccagtccctgcctagtctagaagtnttcngtacttactttnttacntcagtactagttactaagtaggtcggtaccgtgggtaccgttcggaccggaaggaccgtaagggacgtaaanacgaaacgacgtgtcggactgaccnccgtntcgttcg

SEQ ID NO: 103366 - DNA, 639 bp, Homo sapiens
  misc_feature: GYAE6OF01BQ879.34.34.D01.1.454.CMB.1.raw
  modified_base (301)..(301): a, c, t, g, unknown or other
  misc_feature (301)..(301): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtccccaggggaaagagccatcctctcctgcagggccagtcagagtattagcaccaacttgcctggtaccagcagaaacctggccagactcccaggctcctcatctatggtcncactccaccgagggccacgtggtactcccgaggctaggttcaggtggactagggtcgggtcgtggggaactaggtacgtttccacgttcctaccaacctatccaggctagttctgactaggttctaggtaagttacttttgacgtttagttttacttactcgtacgagtacctaacttaattaaacggttaacggtccgggtacccttaccggtaacttcccgtacccgtttaccgggaaccgtaaagggaccctaacggtacgttacgggtaaagtaaacgtttaaaaccggaacgttggttacggtacttacgaacccgtacctgttccgttaccg

SEQ ID NO: 103367 - DNA, 670 bp, Homo sapiens
  misc_feature: GYAE6OF01C01RM.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagaccaccactggagaaatagtgatgacgcagtctccagcccaccctgtctgtgtctccgagggaaangccaccctctcctgcagggccagtcagagtgttggcagcaacttgcctggtaccagcaagaacctggccaggcctcccagacgtcctcatctatgcctacactcccaccgacgggcccacgtcgcttacttcccacgtccgtaggtttccaggtggccgtaggttcggggtacctaggggacctaggtacgtttccaccgttctaccaaccgtacgtccaaggtccaacgtccctaggcctaacggttccttaggaacgttactttccgtagtccctttaacttttttagtaaccttgtacgaagtctaacgttacttaaagttacgggtacgggtccggttagggtacccggtttaccggaccggtaaacgggggtaaccctaaagggggttacgaaaaacgttacggtaaaaaccggtacgttggtacgggtacctacggaccctacctaagttccgtttacg

SEQ ID NO: 103368 - DNA, 599 bp, Homo sapiens
  misc_feature: GYAE6OF01EJ9WX.34.34.D01.1.454.CMB.1.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (399)..(399): a, c, t, g, unknown or other
  misc_feature (399)..(399): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggaagaaatagtgatgacgcagtctccagcccaccctgtctgtcgtctccgaaggggaaancgcccaccctctcctgcacgggccagtcagtagtgtgcagcaacttgcctgaccagcaagaaccgtgccaggctaccagctcctnatctatcgcctacactacccgaccgaggcccatgacttactccagtcctaggttacaggtggctagggtggtcgtggaacagtagttcacgtcacactatcagacngcctcgctacgtcgtagaagtacttactacgtacttaacttttaacttacttcgtacgtacgtactacgtacgttaagtaacggttcgtaccggtacggtaccggttacggtaccgtaaacggaacggtaaacggtacggtaataacgtaaacgtaagtacccccgtaggtacgtacgaccgtaccgtacgtcgttaccg

SEQ ID NO: 103369 - DNA, 257 bp, Homo sapiens
  misc_feature: GYAE6OF01BYC08.34.34.D01.1.454.CMB.1.raw
  modified_base (253)..(257): a, c, t, g, unknown or other
  misc_feature (253)..(257): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttcccgccatctgaatcacgtgtactgagcgggctggcaaggcgcatagnnnnn

SEQ ID NO: 103370 - DNA, 718 bp, Homo sapiens
  misc_feature: GYAE6OF01C2708.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaangcccaccctctcctgcagggccagtcagagtgttggcagcaacttgcctaggtaccagacagaaaccctggaccaggcctcccgagacgtccctactatcctatcgtactaccactacccaaccgacggggaccctacgtctaccttaccgtaccgacgtaccgtaggttaccgtagggtcgcggtacggggttcggtcggtacgggaacgtagtacgttacctacgtacctacctaaccgtactaccgacgtaccgtactccgtacgacgtaacgttacgtaacgtaagttactttccgtagtacctttacgtttttaaccgtcgttacgtacgttaacgtacgttaacgtttaacgtaaggttacgggtacgggttacccggtacgggttaccgggtacccggaaaccgggtaaacggggtaaccggtaaaggggtaaacgttaacgtaaacccggtaaaacggtacggttacggtcgtaccggttacaccgtaccttagttccgtttaaccg

SEQ ID NO: 103371 - DNA, 558 bp, Homo sapiens
  misc_feature: GYAE6OF01CG6H6.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaacttagcctggtaccagcagaaacctggccaggctcccagacgtcctcatctatgctacatccaccagggccactgctatccagccagttcagtggcaggtggtctggacagagttcactctcacatcagcagcctgcagtcagtaacgtacttcgtagtacctactttttattactgtacagtactagttactaaagttaacggtcggaccgtaggtaaccgttccggaccgtaaacgggacgaagggttaggaaactaccgaaaacggtacttacggtacggtctacggaccgaaccctattccgttacgg

SEQ ID NO: 103372 - DNA, 537 bp, Homo sapiens
  misc_feature: GYAE6OF01E1LQE.34.34.D01.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctccagacgtcctcatctatgctacactccacgaggccactgctatccagccagttcagtggcagtggtctggacagtagttcactctcacntcagcagcctgcagtctagagtattcngtcttactttattactgtacagtctagtactaagttacgtcggtaccgtggtacgttcgggaccgtaaaggggaccgtaaagggtcgaaaattacgaaaacggtacgtggtacggtacttacgacctacctagtcgttacg

SEQ ID NO: 103373 - DNA, 253 bp, Homo sapiens
  misc_feature: GYAE6OF01BHC4I.34.34.D01.1.454.CMB.1.raw
  modified_base (251)..(253): a, c, t, g, unknown or other
  misc_feature (251)..(253): n is a, c, g, or t
tcagtacacgtgatcacgaccggtgctcgatttagatcgtctgtgttgggtctgggacagagttcactctcaccatcaacagcctgcagtctgaagattctgcactttattactgtcagcagtctaataagtggccgtggacgttcggccaagggaccaaggtggaaatcaaaacgaactgtggctgcaccatctgtcttcatcttccgcatctgaatcacgtgtactgagcggctggcaaggcgcatagnnn

SEQ ID NO: 103374 - DNA, 578 bp, Homo sapiens
  misc_feature: GYAE6OF01DF4RH.34.34.D01.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangcccaccctctcctgcagggccagtcagagtgttggcagcaacttgcctggtaccagcagaacctggccaggctcccagacgtcctcatctatcgctacactcccaccacgggccactcgctactccagcctaggttcaggtggcgtaggtgggtctgggacngtagttcactctcacatcagcagccgtgctaaggtctaggaagtctttcngtacttacttttactactgtcagtactagtacttaagtaacggtggtccgtagggtaacgttccggaaccgaaggggtacccgtaaagggtcggaaaacttaccggaaaaacggtaaccgttgggtacgtaccgtacggacctaaccgtgtttccgttcgg

SEQ ID NO: 103375 - DNA, 803 bp, Homo sapiens
  misc_feature: GYAE6OF01AO8SC.34.34.D01.1.454.CMB.1.raw
  modified_base (207)..(207): a, c, t, g, unknown or other
  misc_feature (207)..(207): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtcgtctccgaaggggaaanacgccaccctctcctgcgacgggccagtcaggtgttggttcggcagactaacgtttagcccgttaggtaacccaggaccaacggaaaacccgtcgggaccctaacgggccctaccccgaaggtacggttcccctactaacttcctaatcgaccttaccgactcccgaaccgacgggcctacgtcgtaccttacgttacccgacggtccgtaggttcaagggtcggacgtagggttcggggtcgtaggggaactaggtacgtttacacgttcctaccaacctacgtccgaacgccgtacgtcccgtagaccgtaggttacctaggtaacgttccgttacgtacgtacctttaacttttaactacgttacgtactaacggtaccgttaacgttaacgttaaacggttaacgggttccggggtaaccggtttaccgggggttacccggttaaccggggtaacccgggtaaaaacggggtaaccccggttaaaagggggttaaccggtaaaaaccggttaacccgggtaaaaaccggttacggttgggttaacccggtaccgttaccgaacccgtacccgttacggtttcccgttacccg

SEQ ID NO: 103376 - DNA, 649 bp, Homo sapiens
  misc_feature: GYAE6OF01CSVM8.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagngccaccctctcctgcagggccagtcagagtgttggcagcaacttagctggtaccagcagaaacctggaccaggcctccgagacgtccctacatctatcgctacactcccaccgacgggcccactgacctacttcccagtacctaggttcaggtcggacgtaggttgggtccgtagggaacaggtacgttcaccttcctaccacctataccgaggtccacggtcccgtagacctaggtctaggaatctttcgtacgtaccttaacgttttattaccgtagtacagtactaaggtttactaagttacggttcggaccggttagggtaaccgggttccggaaccggtaaacgggtaaccgtaaaggggttaggaaaaccgttaacgaaaaccgggttaacgttcgggtacgggtacttacgggacctaaccggtgtttccgttacgg

SEQ ID NO: 103377 - DNA, 659 bp, Homo sapiens
  misc_feature: GYAE6OF01DIGLB.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtgtctccgaaggggaaancgcccaccctctccgtgcgagggccagtcagtagtgtggcagccaattcgccgtggtaccagacaagaaaccgtggccaggcctccgagacgtcctcatcgtatcgactacactacccgacgtacggccacgtgtacctacttaccgacgtaccgtaaggtttccgaagggttcgggcggtacgggtttcgggtcggaggggtaactaggtaacgttacgtaacttacgtacccgtacctacgtaccgacaccggtacgtccgtacgtacgtaacgttcgtaaggtagttcttcgtacgttacctttaacgttttacttaacgttcgtacgtagtaccgttaacgtacttaaaggtacggtcggttaccggtacgggtacggtaccggacggaaacggtaagtacggtaagaaactacgaaacgtcgtaggcgtctagacctacttagtcgttcg

SEQ ID NO: 103378 - DNA, 528 bp, Homo sapiens
  misc_feature: GYAE6OF01DXLC5.34.34.D01.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
  modified_base (521)..(521): a, c, t, g, unknown or other
  misc_feature (521)..(521): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgtggcagcaacttagcctggtaccagcagaacctggccaggctcccagacgtcctcagtctatgctacactccaccgagggcccactgctaacttccagccgtaggttcaggtggctaggtgggtctgggacaggngtttcactctacaccatcagtccagtctgcagtcagatatctgctaacttttatactgtcaagctagttactaagtaggttgccgtggtaccgttccggacgagggaccaagggtacgaaatacgaaacgacgtggacggtgtacacactntcgtacg

SEQ ID NO: 103379 - DNA, 596 bp, Homo sapiens
  misc_feature: GYAE6OF01EVT70.34.34.D01.1.454.CMB.1.raw
  modified_base (297)..(297): a, c, t, g, unknown or other
  misc_feature (297)..(297): n is a, c, g, or t
  modified_base (466)..(466): a, c, t, g, unknown or other
  misc_feature (466)..(466): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaagacgccaccctctcctgcagggccagtcagagtgtggcagcaacttagcctaggtaccagctaacgaaacctggccaggctcccgaggcctcctnatctatgatcgccgtccaacgagggccacgtcgcactccagcctaggttcaggtggcaggtcgggtcgtgggcctaagacctttcaaccttctccacatccagccagcctagaacgacctaaagtatttacgacttaaattttacttactgtcgtaagcttagcggtanacgtaacgtcgtacccttccgtaggaccgccgtaccggttccgggaccggtaacggaccggtacggtacggtagggtaacgtaaacgttaaaaccggacgttcggtacgggtccgtacggctaccgtacg

SEQ ID NO: 103380 - DNA, 812 bp, Homo sapiens
  misc_feature: GYAE6OF01CP7VS.34.34.D01.1.454.CMB.1.raw
  modified_base (206)..(206): a, c, t, g, unknown or other
  misc_feature (206)..(206): n is a, c, g, or t
  modified_base (759)..(759): a, c, t, g, unknown or other
  misc_feature (759)..(759): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccatggagaaatagtgatgacgcagtctccagcccacctgtctgtgtcctccgaaggggaaancgcccaccctctcctgcgagggccagtcaggtagtggtcgacagactaacgttcggcgttacggaccagaccgaaacgtaaccgtcggaccgacggtccctaccgaaggtcctccctatactaccttagcctacctaacctaccgtacccgaaccggccgggaccccacgttacgtaccttaccgtacccgacgttaccgtaggtttacgacggttcgggacggttacgggtcgggtacgtaggtaaccgttaggtaaccgttccaccgtttaccaacctaccgtaagtacccgtacggcccgtacgtccgtagtaccgtagggttaacctaggttaaaccttcgtttaccgtaaacgtttacctttttaacggttttactaccgggttccgtaacgttaacgtaacggtttaaaacccgtttaacggttagggttaacccggggttcccggggttaaccggtttaccgggaccggttaaacccgggggaaccggaaaacggttacggggtaaaacggttaaccgtaaaaccggaaacgtttaaacccggggnggtttccgtaaacggcccgttacaacccgggttcttacggtttcccttaaccg

SEQ ID NO: 103381 - DNA, 646 bp, Homo sapiens
  misc_feature: GYAE6OF01CXHS5.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgtggcagcaacttagcctggtaccagcagaaacctggaccaggcctcccagacgtcctcatcctagtgcctacatcccaccgacgggaccactgctacttccgagcctaggttcaggttggctaggtgggtccgtggggtaacaggtacgtttccgacttcgtaccaccacttcacgacacgtcctgacctaaggttcctaggaaactcgttttcctagtaccttaactttttaagttactttcggtactaacgccgtttaacttaacgttaaagttaacgggttcgggtacccggttgggtaaccggttaccgggaaccggtaaaccggggaccgtaaaggggtagtaaaataaccggaaaacggtaacgttcggtacggtacgtacgaccaacctaagttccgttaacg

SEQ ID NO: 103382 - DNA, 897 bp, Homo sapiens
  misc_feature: GYAE6OF01B91XX.34.34.D01.1.454.CMB.1.raw
  modified_base (215)..(215): a, c, t, g, unknown or other
  misc_feature (215)..(215): n is a, c, g, or t
tcagtacacgtgatcacgaccggtgctcgatttagatcgtctgtgttgggtttgggggaggtaacgtgtctcaggttaggacccagacggaaccatggaacgccccagcgcaggcttctcgttcctcctcgcttactctcggctcccagacacccatcggagaaatgtgatgacgcagtctccagccacctgtctgtcgtctccgaaggggaaancgccaccgtctctgacaagggcctagtccagtagtcgttaggcagccaattagcctacggtaccagaccaacgaaaacctggaccaaggtcctacccgaggactacctacactcgttaagtcgtacctacactcccgtaaccgacggggtccctaacgttaggtccttaacttacccgaacggtccccgtaacgggtttaccaacggtttcgggtacccgtaagggttccggggttaccgtacgggggtaaccgtaacgggtaacgggtttaccaaaccggtttcccttaccgttaaacccgttacgtttacccgaaccggtcccgtaaacggtccccgtttacggaaccgtaacgggttacccgtaaggtaaacggttaccgttttacccgtacgttaaccgtttaaccgttttttaacccgtttaaccccgggttaaccgacggttaacccgtaaacgggtttaaccctttaaacgggtttaaaccgggttccgggacccgggtttaccgggacccggtttaacccggggaaaccccgtaaaaccgggggtaaaccccttaaaaggggttaaccggtaaaacgtttaacccgggtaaaaacccgggtaacccggttacgggttaccgggtaaccttaccggtaacccgaacccgttaacgttccgtttacgggttacccg

SEQ ID NO: 103383 - DNA, 665 bp, Homo sapiens
  misc_feature: GYAE6OF01DNVPO.34.34.D01.1.454.CMB.1.raw
  modified_base (206)..(206): a, c, t, g, unknown or other
  misc_feature (206)..(206): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagaccaccactggaagaaatgtgatgacgcagtctccagcccaccctgtctgtgtctccgaggggaaancgcccacccttctccgtgcagggccagtcagagtgtgcagctaatgcctggtacagcaacgaaccgtggccaggcctacccgagtacgtcctacacttctagttcgacctaacactacccgaaccgacgggtccctaacgtcgtaaccttaccttccgaacgtacccggttaacggtttcaacgggttcggaccgtagggttcgggtaccgtagggggaactacggttaggttaccaccgttctaccaccgtatccgaacgcgtaaccgtcctggacctacggtctaaggaaacgttctttcggagtaccttacttttagttacctgtacagtactagttacgtaaaggtacgtggtacccggttaggtacccggtcggaaccgaaaccggggtaacgtaacgggaacggtaacacggaaaactggttcgacggtactcgaacctctagtcgttaccgg

SEQ ID NO: 103384 - DNA, 589 bp, Homo sapiens
  misc_feature: GYAE6OF01B3D96.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccacctgtctgtgtctccgaggggaaagngcccaccctctcctgcagggccagtcagagtgtggcagcaattgcctggtaccagcagaaacctggccaggctcccagacgtcctcatctatgctacatcccaccagggccactgctatccagccaggtcagtcggcaggtgggtctggggacaggtacgttcacgtcctccaacctatcgacgtccacggccctgccagtcctagaagtattctgtacctattttattactgtcagctagtacttaataggtcggtaccggttggaaccggtttacgggacccgtaaaggggtaaccgtaagggggtaacggtaaaagtacccgtaaaaacggtaaccggttggttacgggtactacggacctaacccgtagtcgtttaccgg

SEQ ID NO: 103385 - DNA, 639 bp, Homo sapiens
  misc_feature: GYAE6OF01ANPJ1.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaacctggccaggcctcccgagacgtcctcattctatgcctacactccaccgagggcccagtcgctattccagcctaggttcagtggctaggtgggtctgggacagtacgttcactctccaacatcagcacgtcctagcctagttctaggacgtactttcgagtaccttaacgttttaattacgtcgttacgaacgtactaacggtttaccttaaaaggttaacgggtcggttacccgggttacgggtacccgggtttaccgggacccgtaaaacggggtacccgtaaagggggttacggtaaaaactaccggaaaaacgtacccggttaggggtaccggtaccttacgggaccctaaccggttgttccgttaccgg

SEQ ID NO: 103386 - DNA, 698 bp, Homo sapiens
  misc_feature: GYAE6OF01A3DBN.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtggttggcagcacttagcctggtacccagcaagaacctggaccacggctaccgagacgtcctcatctatcgctacactccacgacggccacgtcgactacttccgacgtccgtaggttacaggtcggcgtagggtgggttcgtaggggaactaggtacgttcctacgttccacgacctatcgaacgcgtacgtcctggacctagttacctaggaacgtactttccgagttaccttaacgtttttaactttacgtacgtttaccgaaggttaccttaacgttaaccgtttaaaaggttacggggttcgggtacccgtttacggggtacccggtttaccggggtaaacccggaaacgggggttaaacccggtaaagggggtttaaaccggaaacggttaaccgtaaaacggaccggttagggtaccgggtaacctacggaaccggtaccttacgtccggttttaccg

SEQ ID NO: 103387 - DNA, 712 bp, Homo sapiens
  misc_feature: GYAE6OF01BG144.34.34.D01.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaangccacctctcctgcagggccagtcagagtgtgcagctaactgcctggtaccagacaagaacctggaccaggcctaccgagtacgtcccctanactctatcgactacactacccacgtacgggcctacgtcgtcttacttcccgacgccgtaaggtttccagggttcgggacgtaggggttcgggtaccgtagggggaactaggtacggtttaccaccttaccgtaccaccgtaactcgacgtcgaacgtcccgtagaccgtagttaccgtaaggaacgttcgtttaccgtagtacctttaactttttacgttaacgttcgttacgaacggtaccttaaggttaaccgtttaaagttacgggttcgggtaacccgggtttagggtacccggtttaccgggaacccggtaaacggggtaaacccggtaaaggggttacgtaaaacgttaccggaaaaaccgttacggtacggtacggtacgtacggaacctaccgttacggttcgttaccg

SEQ ID NO: 103388 - DNA, 498 bp, Homo sapiens
  misc_feature: GYAE6OF01EY6HI.34.34.D01.1.454.CMB.1.raw
  modified_base (203)..(203): a, c, t, g, unknown or other
  misc_feature (203)..(203): n is a, c, g, or t
  modified_base (492)..(492): a, c, t, g, unknown or other
  misc_feature (492)..(492): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtgcagtgggtctggacagagttcactctcaccatcagcagcctgcagtctgaagtattctgctactttattactgtcagtcagtctaattaagtggccgtggacgttcggccaagggaccaagggtgaaatcgaaacgactgtcgctgacactntcgtcg

SEQ ID NO: 103389 - DNA, 531 bp, Homo sapiens
  misc_feature: GYAE6OF01BJGTN.34.34.D01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctntcctgcagggccagtcagagtgttggcagcaacttagcctggtaccagcagaaacctggccaggctcccagagtcctnatctatgctacatccacaggccactgctatccagccaggttcagtgcagtgggtctggacaggattcactctcaccatcagcagcctgcagtcagaagnttctgctacttttatactgtcagctagtactaagttagtcggaccgttggaccgtttcggaccgaaagggacctaagggtacgtaaatacgaaaacggtaccgttaggtacggaccgttacgacctaccgtagttccgttcg

SEQ ID NO: 103390 - DNA, 712 bp, Homo sapiens
  misc_feature: GYAE6OF01ARQ9K.34.34.D01.1.454.CMB.1.raw
  modified_base (235)..(235): a, c, t, g, unknown or other
  misc_feature (235)..(235): n is a, c, g, or t
  modified_base (573)..(573): a, c, t, g, unknown or other
  misc_feature (573)..(573): n is a, c, g, or t
tcagtacacgtgatcacgaccggtgctcgatttagatcgtctgtgttgggtttgggggaggaacgtgctcagttaggacccagacggaaccatggaagccccagcgcagcttctcttcctcctgctactctggctccagacaccactggagaaatagtgatgacgcagtctccagccacccgtgtctgtgtctccgaggggaaagcgcccacctctcctgacagggccagtcagngtgtggcagctaacgttgcctggtaccagcaacgaacctggccaggcctccgaagacgtcctacagttctatcgtacctaacactcccgaaccgacggggccctaacgtcgacctttaacttcccgaagtcccgtaggtttaccaaggttcgggcgtaacgggtttcggggtactagggggtaccaaggttacgttaccgtaacctttcctaaccgaacccgtacttaccgaacggcctaacgggtcccgtttcgaacgttacggtaccgttaagggtaacgttaacgtttccgttacgtaccttttaaccgttttaacgtttaaccttcggttaacncggtaacgtacggttacttaaacggttacggtcgggtccgttaggtaacccggtttcggacccggaaacgggtaactaacgggtacggtaaactacgtaaacgtacgttaggcgtacgtacgcctaactcgtagttccg

SEQ ID NO: 103391 - DNA, 811 bp, Homo sapiens
  misc_feature: GYAE6OF01DAWUD.34.34.D01.1.454.CMB.1.raw
  modified_base (608)..(608): a, c, t, g, unknown or other
  misc_feature (608)..(608): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtcgtctaccgaaggggaaagcgcccaccctctcctgcgagggccaggtcaggtagtggttggacacgtacgtaactttacggccttacgggtaacccaggaccaacggaaaaccgttcgggacccgaacgggtccctaccccgaacgggtacttacctacctaattccgttaacgtcgtaacctaacgacctacccgaacccggaacgggtccctaactcgtaccttaacgttacccgaacgtccgttaacgggttccaagggttcgggaccggtaggggtttacggggtccggtaacggggaccttaacgttaccgttacccgaccttaccgtaccctaacctacgaccctaaccggtaacgtacgtacgggtacgtacccgttaaggtaaaacgtttgttttaccggattaacgggtttntttaaacgtttacgtacgttaaccttaacgttcgggtttaccggtaccttaccgaaccgttacgtaaccgggttacggttaccgggttaccggaaacgggtaaaccgggtaaccggaaagggtaaacgaaaacgtaaccggtaaaacggtacgttcggtacgggacttaacgacgtaacccttgtaccgttcgtacgttaccg

SEQ ID NO: 103392 - DNA, 547 bp, Homo sapiens
  misc_feature: GYAE6OF01AGHJ5.34.34.D01.1.454.CMB.1.raw
  modified_base (202)..(202): a, c, t, g, unknown or other
  misc_feature (202)..(202): n is a, c, g, or t
  modified_base (409)..(409): a, c, t, g, unknown or other
  misc_feature (409)..(409): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaangccaccctctcctgcagggccagtcagagtgttggcagcaacttagcctggtaccagcagaaacctggccaggcctccagacgtcctcatctatcgctacactccaccgagggcccacgtgctacttccagccaggttcaggtggctaggtcgggtctgggacagtcgttcactctcacatcagcagcctagcagtctagaatcttngtactacttttatactgtacagtactagtactaagtaggtcggtaccgtggtaccgttcgggaccgtaaaggggaccgtaagggtacggaaactacggaaaacggtactgggtacggactagacctacctgtcgttcg

SEQ ID NO: 103393 - DNA, 802 bp, Homo sapiens
  misc_feature: GYAE6OF01CPO9I.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaancgcccaccctctcctgcgacgggccagtcagagtgttggcagcacttagcctggtaccagcaagaaacctggaccaggcctaccagtacgtcctcattctatcgacctacactcccgaaccgacgggaccctacgttcgtacctacttacccgaaggtcccgtaaggtttcgaacgggttcggggaccgttaggggtttcggggttaccgtacgggggtaaccctaagggttacggtttcccaaccgtttcccgaacccgtaacccgtactttacccggaacgggtccctaacgggtccccgttaggaccgttaacgggtttaccgtaagggttaaacgtttacgttttttacggaaccgttttaaagttttttaacgtttaccgttcggttaaccgtaagtacccgttaaattaacgtttaaagttaacggttccgggtaccccttaccggtaccttacccggttaccccggtttaccgggaaacccggaaaggggtaaccctaaccgggtaacgttaaacgggtaaacgttaaaccggtttaaaaccggacgtttacggggtaccggtacctaccgggtaacccttaacccgttacg

SEQ ID NO: 103394 - DNA, 731 bp, Homo sapiens
  misc_feature: GYAE6OF01CYYQ5.34.34.D01.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagatatcaccggagaaattgtgttgacacagtctccaggcaccctgtctttgctccgaggggaancgccaccctctcctgcagggtcagtcagcgttctaacnccgtacttctcgctggtaccagtcagacgaccgtgggccagggcctcccgagggccttccctcagttcttttgggcgtccgtcccaaccgtacggggccctaacgtcggacctactccccgagtacgtacgggttcaggtcggaccgtaggttcgggtacgtgggacaacggtcctttcgaaccgttctaccgaactacgtcgaacgacgtacggtacttggacgtccgtagaacgttacgttttcgactaagttattacgtttacgtcgtactacgtaactaagtagtaccggtaagaccgtacggtaccgtagggtccggggtacgtttaccgggaccggtaaacggggtaacccgtaaaggggtaccggttaaaaacgtaccgggtaaaaccgggttaacgttaccgggtaacgggtacccttaacggaaccccgttaaccgttaacgtttcccggttaacccggtttaccgttccgtttaaaccccgg

SEQ ID NO: 103395 - DNA, 809 bp, Homo sapiens
  misc_feature: GYAE6OF01CGF2F.34.34.D01.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagtacacgtgatcacgaccggtgctcgatttagatcgtctgtggttggggtttgggggaggaactgctcagttaggacccagacggaaccatggaagccccagcgcagcttctcttcctcctgctactctggcctcccagacaccactggaagaaatagtgatgacgcagtctccagcccaccctgtctgtcgtcctaccgaaggggaaancgccctaccctctccngcgacgggccagtcgagtacgtgtcggcagactaacgttcgcctggaaccagacaagaaaccgtggaccacggcctaccgaggtccgtcctactattctagtccgactaaccgactacccgaacgacgggaccctacgtcgtaccttaaccgttcccgaacggtaccgttaaggttccgaacgggtttcgggacgtacggggtttacgggttcggtaacggggtaacgtaggttacgttaccctaccgttccgtaccctaaccgtgttacccggaacgtaccgtaccgtcccgttaggacccgttaaggtaccgtaggtaaaccgtttcgtttaccggtacgtttaaccgtttaaccttttttacggtaacccgttagtccggtaaacgttacgttaacggttaaacgtttaacggtaacgggttccggtacccgggtttaacgggaccgggtttaacccgggaaccggtaaaacccgggggtaacggttaaacgggtttaaccggaaaaacctttaccggaaaaccggttacggttacggtccgggtacctacggaccttaccggtagttccgttaccg

SEQ ID NO: 103396 - DNA, 797 bp, Homo sapiens
  misc_feature: GYAE6OF01EHUVC.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaancgccaccctctcctgcagggccagtccagagtgttggcagcaacttagccgtggtacccagtcaacgaaacctggacccaggcctacccgagacgtccctacatctatgacctacgactcccgaccgacgggaccacgtgaccttaacttccgacgtccctaaggttccagggtcggcgtagggtcgggtacctaggggaactagtacggtttcaaccttcaccaccgataccaggtaccacgtccctgaccgtagttacgtacggtaaacgttagtttccgtacgtacccttaacggttttttaactttaaccggttcgtttaccgaaggttacccgttaaacggttttaacccgttaaaaggtttaaacgggtttcggggtaccccggggtttacggggttaacccgggttacccggggtaaaacccgggttaaaaccgggggaaaccccggttaaaaggggggtaaccgggttaaaaaaccgtttacccggtaaaaaaccgggggttaaacccgtttagggggttaccgggtacccggttttaacgggaaccccccgtttaaacccgttaacggtttcccggtttaacccgg

SEQ ID NO: 103397 - DNA, 851 bp, Homo sapiens
  misc_feature: GYAE6OF01DRDN9.34.34.D01.1.454.CMB.1.raw
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
tcagtacacgtgatcacgaccggtgctcgatttagatcgtctgtgttgggttttgggggaggaactgctcacgttaggacccagacggaaccatggaagccccagcgcagcttctcttcctcctgctactctggctccagacaccacgtggagaaatagtgatgacgcagtctccagccaccctgtctgtgtctccgaggggaaancgcccaccctctcctgccgagggccagtcagngtgttgcagcaacttgcctgtaccagccaagaaacctggccaaggcctacccagacgtccctcatctatcgactacagtcccgaccgacggccctaacgtgtccttacgttccgaacgccgttaggttcgacgtgggtaccgtagggttcgggtacgtacggggaactacgggtacgtttccgaaccttacccttaccgaacccttagtacccgaacgtacccgtaacggtccccgttggaccgttaaaccggttcgttaaacgggtaaacgttcgtttttacccgtacgtacccgtttttaacctttttttaagttttaacccgttgggtttaaccccaaagggttaccctaaagggttttaacccgtttaaaaaggtttaaaccggggttcccggggttaaccccgggtttacggggtaaccccgggtttaacccgggggtaaacccgtaaaacgggggggtaaacccccgttaaaaaggggggttaaacccggtaaaaaacgggtttaaaccccgtaaaaaaccggggttaaacccggtttggggttaacccggttaccggttaacccggacccgttaaaacccgttggtttaacccggttttaacccgg

SEQ ID NO: 103398 - DNA, 722 bp, Homo sapiens
  misc_feature: GYAE6OF01CPKDE.34.34.D01.1.454.CMB.1.raw
  modified_base (210)..(210): a, c, t, g, unknown or other
  misc_feature (210)..(210): n is a, c, g, or t
  modified_base (363)..(363): a, c, t, g, unknown or other
  misc_feature (363)..(363): n is a, c, g, or t
  modified_base (480)..(480): a, c, t, g, unknown or other
  misc_feature (480)..(480): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggaagaaatgtgatgacgcagtcctccagcccaccctgtctgtcgtctaccgagggggaaacncgcccaccctctcctgacgacgggccaggtcaagtggttgtcggcaggactaacttcggccgtaggtaaccagaccgaagaaacccgtgggaccctaacgggcctaccccgagggtacccttcctactaactccttaagtccgaccttaaccnccgtacccgaaccgacgggtacccctacgtcggtactaacgttcccgaggtaccgtaggttccgagtcggacgtgggttcgggtcgaggggtacaacgttacggttccattacccgntaaccctatccgaagcccgtagccgttagacgttaacgtctaggaattcgttccgtactatttacctttttaatccgtgtacacgttaacgtagttaaccgtaaagttcccgggcggttaccggtagggtacccggttacgggaaacccggaaacggggttaacgaagggttaaaccgggaaactaacccgggtaaaggttccgacgggttcaccgtaccgaaccttacacgttctttaccg

SEQ ID NO: 103399 - DNA, 628 bp, Homo sapiens
  misc_feature: GYAE6OF01D6NFM.34.34.D01.1.454.CMB.1.raw
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgccaccctctcctgcagggccagtcggagtgttgcagcaacttgctggtacngcaagaacctggccaggctaccagacgtcctcatctatcgactacactcccgaccgagggccacgtcgactacgttacccagtccgtaggttccaggtggacgtagggttcgggtcgtagggaactagtacgttccacgttctaccaacctgtacaacgtccaacgtcgtacgccgtagttcctaagaacgttctttacgtgttaccttacttttaacgtaccgtgttaccaggtactacggttaactaaggttacggtcgggtcgttacggtacggttcccggaacggtaaacgggtaccgaagggttaacggaaactaccgaaacggtacggtaggtcgacgttgaaccctagtacttcgtgttaccc

SEQ ID NO: 103400 - DNA, 530 bp, Homo sapiens
  misc_feature: GYAE6OF01AX1A9.34.34.D01.1.454.CMB.1.raw
  modified_base (411)..(411): a, c, t, g, unknown or other
  misc_feature (411)..(411): n is a, c, g, or t
  modified_base (523)..(523): a, c, t, g, unknown or other
  misc_feature (523)..(523): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaacttgcctggtaccagcagaaacctggccaggcctcccagagtcctcatctatgctacatcccaccagggccatgctattccagccaggttcaggtggctaggtgggtctgggacaggtagttcacctcgtcaccatcagcacgcctgcagtctagaagtacttcncgtacttacttttatacttgtctagctagttactaagtaggttcggcgtggacgttcggaccgaagggaccgaagggtagaactacgaaacgacgtggtagctacgacactntcgtacg

SEQ ID NO: 103401 - DNA, 576 bp, Homo sapiens
  misc_feature: GYAE6OF01DECD9.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgccaccctctcctgcagggccagtcagagtgttggcagcaacttgcctggtaccagcaagaaacctggccaggctccccagacgtcctcatctatgctaccactccaccgagggcccaactgacctattccagccaggttccagtcggctaggtggtcgtagggacagtacgttcacgttcacaccatcagcgagcctgcgagtctagaagtactttctgtacttacttttatacttgtcacgtctagttacttaagtaacgtgggtaccgttagggcgtttaaccggcgtaaacggggaccgtaaagggtaacggtaaactaacgaaacggtaacgttggacgtaccgtagaccgactacgtcgttacgg

SEQ ID NO: 103402 - DNA, 286 bp, Homo sapiens
  misc_feature: GYAE6OF01CX5K0.34.34.D01.1.454.CMB.1.raw
  modified_base (260)..(286): a, c, t, g, unknown or other
  misc_feature (260)..(286): n is a, c, g, or t
tcagtacacgtgatcacgaccggtgctcgatttagatcgtctgtgttgggtcgtgggacagagttcactctcaccatcagcagcctgcagtctgaagattctgctactttattactgtcagcagtctaataggtgccgtggacgttcggaccaaagggaccaaggtgaaaatcaaaacgactgtggctgcacatctgtctcatcctccgcatctagaatcgagtgtaactggagcgggctaggacaaggccgacagtagnnnnnnnnnnnnnnnnnnnnnnnnnnn

SEQ ID NO: 103403 - DNA, 634 bp, Homo sapiens
  misc_feature: GYAE6OF01BNMJJ.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagataccactggagaaatagtgatgacgcagtctccagccaccgtgtctgtgtctccgaggggaaangtccaccctctcctgcagggccagccagagtgttagcagcaagttggcctggtaccagcaagaaacctggaccagggcctccgaggcctcctacgatctatggtgactactccgaaccgacgggcctacgtcggtactcccgagcctaggttcaggtcggcaggtcgggtcgtgggaactaaggtacttcgacctctaccgaactactcgagaccacgcccgtagactacggttactaaggtaaattgtttacgtacgttaagtttttaactcgtacgtacaagtactaaggttaaacttaacgtacggtccggtacccggtaccggggtaccttaccgggaccgtaaggaaccgtaagggtacgtaaacgttacggaaacgtacggttggtaccggctaacggtcctaactagtccttgtccttaccg

SEQ ID NO: 103404 - DNA, 542 bp, Homo sapiens
  misc_feature: GYAE6OF01ED385.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangccaccctctcctgcagggccagtcagagtgttggcagcaacttagcctggtaccagcagaaaccctggccaggcctcccagacgtcctcatctatgctacatccacgaggccatgctatccagcctagttcagtcggcaggtggtctgggacagtgttcactctaccactatcagcagcctgcagtcagagtcttctgtcttactttatactgtactagactacgttactaaagtacggtcggccggttaggtaccggttccggaaccgtaacgggaccgtaagggtagaaactacgaaaacgtacggtgtcggactcgacctacgtatcgttacg

SEQ ID NO: 103405 - DNA, 563 bp, Homo sapiens
  misc_feature: GYAE6OF01BI96D.34.34.D01.1.454.CMB.1.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctcagggaanagccaccctctcctgcagggccagtcagagtgttggcagcaactagcctggtaccagcagaaacctggccaggctcccaggcctcctcatctatggtgcatcccaccgagggccactggtactccccgagtccaggttcaggtcggcgtaggtgggtctgggacaagtactcacgtctacacctatcagccagtcctgcagtctagaagtnttttgacttagttttactacgtgtacagtactaagttaataactacgtcggtccgttccggggtacgttcggaaccgaagggaccgtagggtagtaacgtacgaaacgtacgttggacgacgttacgacacccgtattcgtcgttcttaccg

SEQ ID NO: 103406 - DNA, 617 bp, Homo sapiens
  misc_feature: GYAE6OF01AX5NW.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgcccaccctctcctgcagggccagtcagagtgtggcagcaacttagcctggtaccagcagaacctggccaggcctcccagacgtccctcaactctaagtcgctacactccaccgacgggcccacgtgcttacttcccgagccgtaggttcaggttcggacgtagggttcggggtaccgtggggaacctaggtacgtttccaacgttcctaccacctagtccgaaggtccaacgtccctggtaccgtagttccgtagaacgttactttcgtacgtacttaacgttttattacgtggtcagtactagttactaacgtaggtcggtaccgtgggtaccgttacggacgtaaacggtacgaagggtcgaaacgtacgaaaccgagttggacggcttacggaccctactgttcgtcg

SEQ ID NO: 103407 - DNA, 574 bp, Homo sapiens
  misc_feature: GYAE6OF01BVRG6.34.34.D01.1.454.CMB.1.raw
  modified_base (429)..(429): a, c, t, g, unknown or other
  misc_feature (429)..(429): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaagagccaccctctcctgcagggccagtcagagtgttggcagcaacttagcctggtaccagcagaaacctggccaggctcccagacgtcctcatctatgctacatccaccagggccactgctacttccagccaggttcagtggctaggtcgggtctgggacagtagttcactctacaccatacagcacgtacctgactagtctaggaacgtcttcgtgtactaactttntttaactggtacctagactagtactaaagttaaggtcggtaccgtgggtaccgttcggaccgtaaaggggacccgtaaagggtacgaaacgtaccggtaaaacgtaaccgtggtacgggtcttacgaccaaccgtagttcgtacg

SEQ ID NO: 103408 - DNA, 535 bp, Homo sapiens
  misc_feature: GYAE6OF01CYTL6.34.34.D01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (515)..(515): a, c, t, g, unknown or other
  misc_feature (515)..(515): n is a, c, g, or t
  modified_base (527)..(527): a, c, t, g, unknown or other
  misc_feature (527)..(527): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatatcaccggagaaattgtgttgacacagtctccaggcaccctgtctttgtctccaggggaaangccaccctctcctgcagggccagtcagagtgttaatagcatctacttagcctggtaccagcagaaacctggccagcctcccagactcctcattaatggtncatactacgagggcccctggcatcccagacaggttcagtggcagtgggtctgggacagacttcactctcacatcaccagactggacgcctagaagtagttttgacgtagttgtattactgtactaacgtagttggtctacgaacacgacggtggtacgttcggacgaagggaccaagggtaggaaactacgaaacgaacgtgtggctgcacntctagtcttacntcctcccg

SEQ ID NO: 103409 - DNA, 664 bp, Homo sapiens
  misc_feature: GYAE6OF01ALCB9.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaanacgccaccctctcctgcagggccagtcagagtgttggcagcaacttagcctggtaccagcagaaacctggccaggcctccgagacgtcctcatctatgctacactccaccgagggccactcgctacttccgagtccctaggttccaggtggcgtaggtcgggtctggggtaacagtacgtttaccacttctaccgaccactcagtccacggccttcggactagtctaggtaagtatttcctagtaccttactttttacttacgttacgtacgtaacgtactaaggtttaccttaaaacggtttaacgggttcgggtaccggttacggggtaaccgggtttcccggggacccgtaaagggggtaacccgtaagggggtaacggtaaaacggtaccgtaaaaccgggtaacgttacgggtacggtaccttacgggacctaacccgtacttccgtttaccgg

SEQ ID NO: 103410 - DNA, 634 bp, Homo sapiens
  misc_feature: GYAE6OF01BTZMN.34.34.D01.1.454.CMB.1.raw
  modified_base (357)..(357): a, c, t, g, unknown or other
  misc_feature (357)..(357): n is a, c, g, or t
  modified_base (482)..(482): a, c, t, g, unknown or other
  misc_feature (482)..(482): n is a, c, g, or t
tcagtacacgtgatcacgaccggtgctcgatttagatcgtctgtgttgggtttgggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctggcggggccagtcagagtattagtagctacttcttagcctggtatcagcagaaacctggcctggcgcccaggcctcctcatctataatgacctatacgcgagggccacgtggccgtacccagtacgaggttcaggtcggngaggtgggtcgtggggcaggtaccttgacttccacacctagtcacggcgagtacgtaggacgtccgtaagtaagttagttacgacgttaaggttatttagttacgttcgtaacgtacgacggtanacttacgtacgtacggttaccggtacctaccgttacgtttacgttccggacgggtaaccggacgaacgttccggaaggtaccgtaacgtaaaccaacggttaacggtcggtacgtacgtaccggaccctaacttaccgttgttacgttaccg

SEQ ID NO: 103411 - DNA, 584 bp, Homo sapiens
  misc_feature: GYAE6OF01EF4E5.34.34.D01.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaacctggccaggctccagagtcctcatctatgctacactccaccacgggccactcgctacttccacgcctaggttcaggtggacgagtcgggtactgggacagtacgttcactcctacaccatcacgcgacgtcctgctagttctagaatacgtttcngtacctagttttacttactcgtacagctagtacctaaagttacggtcggtaccggtagggtaccgttccggacgtaaacggggaaccgtaagggtacggtaaactacgtaaaaccggacgttgggttacggtctacgtaccgtaaccctagttccgttaccg

SEQ ID NO: 103412 - DNA, 685 bp, Homo sapiens
  misc_feature: GYAE6OF01AV3WJ.34.34.D01.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgccaccctctccngcagggccagtcagagtgtggcagcaacttgcctggtaccagcagaaacctggccaggcctccagacgtcctcatctatcgctacactccaccgacgggccactcgactacttccagcctaggttcaggtggcaggtcgggtctgggactaggacttcactctacaccactcgaacgcgacgtccctgacctagtctaggaacgtatttcctagtacttaccgtttttatttaccgtcggttactaacggtacgttacgttaaccttaaaggttaaccgggtttcggtacccgggtttacgggtaacccggtttcccggggaacccggtaaaacgggggtaaccccggttaaaagggggtaaaccggttaaaacggttacccggtaaaaaaccgggtaccggtttaaggggtaccgggttaccgtaaccgggtaaccaccccggttaaggtttcccgtttaacccgg

SEQ ID NO: 103413 - DNA, 782 bp, Homo sapiens
  misc_feature: GYAE6OF01DAXZD.34.34.D01.1.454.CMB.1.raw
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagcccaccctgtctgtgtctccgaggggaaancgccaccctctcctgcagggccagtcagagtgttggcagcaacttgctggtaccagcaagaacctggccaggctccaggntccnatctangctacactccacgacgggcctacgtgcctacttccacggtacctaggtttccaggtcgggccgtagggtcgggttcgtaggggaacaggtacggttccactttccgactaccaatccgaggcaacgtcccgtgtaccgtaggttacctacggtaacgttactttccgtacgacccttttaactttttactaccggttgttaccgaacgttaaccgttaacggtttaaacgtttaaacggtaaaggggtttccgggggtacccgggttttacgggggtaacccggttttaaccccgggggaaacccgggtaaaaaaccggggggttaacccccgggtaaaaaagggggggtttaaaccgggtaaaaaaaacccgtttaaaccggggaaaaaaaacccggttaaacccgggtttggggtaaacccgggttcccggtttaaaccggaccccccgtttaaaccgggtaacgtttccgggtttttaaccccgg

SEQ ID NO: 103414 - DNA, 539 bp, Homo sapiens
  misc_feature: GYAE6OF01AZ47N.34.34.D01.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (398)..(398): a, c, t, g, unknown or other
  misc_feature (398)..(398): n is a, c, g, or t
  modified_base (530)..(530): a, c, t, g, unknown or other
  misc_feature (530)..(530): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgccaccctctcctgcagggccagtcagagtgtggcagcaacttgcctggtaccagcagaaacctggccaggctaccagacgtcctnatctatcgctacactccacgaggccatgctatcanccagttcagtgcaggtcggtctgggacagacgttcactctacacatcagcacgcctagcagtctagaacgtnttctgtaccttacttttactactgtcagtactaatacgtaaagtacggtcggaccgttaggtaccggtcggacgaacgggaccgtaagggtacgaaatacgaaaacgtacgtggtacgtctacgacctaccngttcgttcg

SEQ ID NO: 103415 - DNA, 545 bp, Homo sapiens
  misc_feature: GYAE6OF01B48ZV.34.34.D01.1.454.CMB.1.raw
  modified_base (203)..(203): a, c, t, g, unknown or other
  misc_feature (203)..(203): n is a, c, g, or t
  modified_base (405)..(405): a, c, t, g, unknown or other
  misc_feature (405)..(405): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgtggcagcaattgcctggtaccagcaagaacctggccaggctcccagacgtcctcatctatgctacactccacagggccactgctatccagccaggttcagtggctaggtgggtctgggacaggtacgttcactctcaccatcagtcacgtcctgctagtctagagtattcngtactacttttacttactgtacagtactagttactaagtacggttggtaccggtaggaccggttcggaccgtaagggaccgtaagggtaggaaactacggaaacgtacgtggtacggcttacggacctactgtcgttcgg

SEQ ID NO: 103416 - DNA, 568 bp, Homo sapiens
  misc_feature: GYAE6OF01AS5MC.34.34.D01.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgttggcagcaacttgcctggtaccagcagaaacctggccaggctcccaggctcctcatctatggtncatccaccagggcccactggtactcccagccaggttcagtggccagtggggtctcgggacagaattcactctcgaccatcagcagcctgcagtctagaagtattttgactagttttattacgtcgtcagtctaagttaataactaacgtcgggaccgttcccggggtacggttccgggaccgtaacgggacccgtaaagggtaggtaaacgtttcgaaaacgaacgttggtacggtacgtcgtaccaccgtatcgtgttccgttaccg

SEQ ID NO: 103417 - DNA, 638 bp, Homo sapiens
  misc_feature: GYAE6OF01DVJ1Q.34.34.D01.1.454.CMB.1.raw
  modified_base (205)..(205): a, c, t, g, unknown or other
  misc_feature (205)..(205): n is a, c, g, or t
  modified_base (629)..(629): a, c, t, g, unknown or other
  misc_feature (629)..(629): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaanacgcccaccctctcctgcagggccagtcagtagtgttggcagctaacttagcctaggtaccagcaagaacctggccaggcctcccagacgtcctctatctatcgactacactccaccgacgggccctactcgactactccagtcctaggttccaggtcggacgtagggttgggtcgtaggggactaggtacgttccacttcctaccacctatccgacgtccacggtcctagtactagttcaaggtaacgtactttccgtgtacctttacttttacgttacgttcgtacgagtaccttaagttaacgtaaagttacgggtcgggtaccggttagggtaaccggttaccggaacccgggtaaacgggaaccggtaaagggtacggaaactaccgaaacggtagtggtacggctacggacctacctnttccgtacg

SEQ ID NO: 103418 - DNA, 640 bp, Homo sapiens
  misc_feature: GYAE6OF01CGRKL.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaancgccaccctctcctgcagggccagtcagagtgttggcagacaacttagcctggtaccagacaacgaaaccgtcggaccaggccctacccgaggtacgtccctctaacgtctatcgacctacgactcccgaaccgacgggtcccacgtcgtaccttacgttcccgacggtcccgtaggttaccgagggttcgggacgtagggttcgggtcgtacggggactagtacgttcaccttccgtaccaaccagtaccacggtccacgtcccgtagaccgtagtacctaggtaactactttcgtcgtactttacttttaactacgtgtactacgtactacgttacgttaagtcgggtacggtccggtagggtaccgtcggaccggaacggtacgaaggtacgaacgtacgtaaaccgtgtacggacgtcgacgactactgtcgtc

SEQ ID NO: 103419 - DNA, 572 bp, Homo sapiens
  misc_feature: GYAE6OF01A1N6D.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccacctgtctgtgtctccgaggggaagacgccaccctctcctgcgagggccagtcagagtgttggcagcaacttagcctggtaccagcagaacctggccaggcctccgagacgtcctcatctatcgctacactccgaccgagggcctagtcgacctacttcccgagtcctaggtttcaggtcggctagggtcgggtcgtaggggacaggtacgttccactctaccgacctactcgacgcacgtcctgactagtcgtagaacgttacttcgtgtacttacgtttattactgtacagtactagttactaagtacggtcggtacggtggtacgttcggacgtaagggaccgaagggtacgaatacgaaacgtacgtggtacgactgaccactgtcgtcg

SEQ ID NO: 103420 - DNA, 711 bp, Homo sapiens
  misc_feature: GYAE6OF01A9YB1.34.34.D01.1.454.CMB.1.raw
  modified_base (205)..(205): a, c, t, g, unknown or other
  misc_feature (205)..(205): n is a, c, g, or t
  modified_base (699)..(699): a, c, t, g, unknown or other
  misc_feature (699)..(699): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctcgaaggggaaancgcccaccctctcctgcgagggccagtcagagtgttgcagctaacttgcctggtaccagacagaaacctggccaggcctaccgagtacgtcctcatctatcgacctacactcccaaccgagggcccacgttcgaccttagttcccaagcccgtaaggtttcgaacggtggaccgtagggtgggttacgtaggggaactaggtacgtttccacgttcctacaccctagtaccgacgcgacgtccgtagaccgaacggttactaaggtaagttacctttccgtacgtaccgtttaaactttttacgtttaccgtacgttacgtacgtacgtttaacggtaaccgtttaaaggttaacgggttccggggtaccggtttaacgggtaacccgggtttaccgggaaaccccgggttaaacggggtaaccggtaaaggggtaacggttaaacgtaacggtaaaaccggtcggttacggtacgacgtcgaaccctacggtnttccggttaccg

SEQ ID NO: 103421 - DNA, 699 bp, Homo sapiens
  misc_feature: GYAE6OF01C7EEB.34.34.D01.1.454.CMB.1.raw
  modified_base (217)..(217): a, c, t, g, unknown or other
  misc_feature (217)..(217): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcctacctgtctgtgtactccgagggaaagcgccacctctccngcacgggtcagtcagagtggttggactaggacaacttagcctaggtaccaggacagaaaccgtggaccgaggcctaccgaggtactcctacagttctaactcgacctaactacacccgaaccgtacgggacctacgtgtaccctaacttcccgaacgtaccgtaggtttaccaagggtcggtccgtaagggtttcgggtacgttaggggaactacggtacgttaccacttaccgacaacctaagtccgaaggtccgaacggtccctggtacttaacgcgtaacgggtaattcgtttacggtaccacctttaacgttttattaacgttcgtacgacgtataagttacttaagggttacgtcggacccggttacgggtaccgttaccgggaacgtaaccgggtaaacgtaagggttaaccggaaagttaaccggaaattaccggtgggcccgtagttaacccgcgtaaacctcgttgttaccgg

SEQ ID NO: 103422 - DNA, 662 bp, Homo sapiens
  misc_feature: GYAE6OF01C34X5.34.34.D01.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (338)..(338): a, c, t, g, unknown or other
  misc_feature (338)..(338): n is a, c, g, or t
  modified_base (503)..(503): a, c, t, g, unknown or other
  misc_feature (503)..(503): n is a, c, g, or t
  modified_base (650)..(650): a, c, t, g, unknown or other
  misc_feature (650)..(650): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagacaccacgtgganaaatgngatgacgcagtctccagccacgtgtctgtgtcctacggaagggaaancgtaccaccctctcgngcgacgggccagcagagtcgtagctagcgtaacgtcggcgtacgaccagacgaacgaaccgcggccgaacggtcctccgacgtcctcctactaactcgtagttcggacacctacncccgacgaacgggcctacgtacgtaccaccgacgcgtaaggttcgtaggtggtacggtcggtacgtacggaactagtacttacacgtacctaccaaacgtatccgagacctacgtccgtagtactacggttagtaagtaagtttgttacgtactttagttactcncgtactagactaagttactaacgtcggtaccggtccggttaaccgggtacgtaacccggacgaaacgggtacgttaaggtacgtaaacgtaacgaaacgtcggtacgtcgggtactaccggaactaccgtacgtttacgtcccgttntaccccgttacg

SEQ ID NO: 103423 - DNA, 785 bp, Homo sapiens
  misc_feature: GYAE6OF01DL490.34.34.D01.1.454.CMB.1.raw
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctactctggcctccagacaccactggaanaaatagtgatgacgcagtcnccagcccaccgtgtctgtcgtcgtaccggaaggggaaacnccgcccaccctcttccgngacgacgggtccagtcaggtagtgtacggctaagacctaacgttacgccgtacggtaaccagaccaaacggaaccgtcggaccacggccctaccgagtaccgttcctactacttcgattcgacctaactcctacccgaacggtacggtcctaacgtcgtaccttacgtaccgacgtaccgttacggtacgtacggttcggacgtagggtttcggtaccgagggtaactacgtacgttcaaccgttcaccacgtactcgacgaccgtacgtccgtaagccgtagttcgtaacgtaacgttacttccgttacgtaaccttttattttaacgttaccgtaggtaactacggttaaccgttaacgtttaacgttaaaccggtaacggggttcccgtaacggggtttacggaacccgggttaccggggtaaaaccgaaccgggggttaaaacccgtaaggggttaaacgaaaaaccggttacccgtaaaaaccggggttacgttacggggaccgttaaccggaaccgttaacccgtaacctttaggttaccccgtttaccg

SEQ ID NO: 103424 - DNA, 724 bp, Homo sapiens
  misc_feature: GYAE6OF01DD2Y1.34.34.D01.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggaagaaatagtgatgacgcagtctccagccacctgtctgtgtctcgaggggaaancgccacctctcngcacggcagtcagagtgtgcagctacttgcctaggtaccagcagaaccgtggccaggcctccgagacgtcctacacttctancgtactaacgactaccaccgacgggacctacgtcgacttacttccgacgtccgtacggttcgacggttggacctaggggtacgggtcgtagggtaactaggtacggttacctaccgttccgtacctaaccgtacttaccgacggtaccgaacgtccgtacgaccgtagtaccgtagtaagttactttcgacgtactttaacttttacgttacgtacgttactaactaccgtaagtttaacctaaaggttaccgggttcggaacccgggtttacgggttaacccggtttaccggggaacccggtaaaaccgggggttaaccgaaaacgggggtttaaacggaaaaccgttaaccgtaaaacggggtaccgtttagggtacccggtaccgtaccgggtaacctaaacccggtagtttcccgttaaccgg

SEQ ID NO: 103425 - DNA, 803 bp, Homo sapiens
  misc_feature: GYAE6OF01DE3MX.34.34.D01.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
tcagtacacgtgatcacgaccggtgctcgatttagatcgtctgtgttgggtttgggggagggaactgctcagttaggacccagacggaaccatggaagccccagcgcagcttctcttcctcctgctactctggcctcccagacaccactggagaaatagtgatgacgcagtctccagcccacctgtctgtntcgtccgaggggaaancgcccacctctcctgcgagggccagtcaggtacgtgttggcaggactaagtttacgcctgggtaaccagcctaagaaacctcgggaccctacgggacctacccgaaggtaccgtccctactaactttcctaatcgacctaacactacccgaccgacggccctacgtcgaccttactccacgtccgtaggttccaagggttcggacgtagggttcgggtacgtacggggactacggtacgttacctacctccgttaccaacctactcgaaccgccgtaacggtcccgtagtaccgtacggttcgttaaggtaactcgtttccggtattaccctttaacgtttttacttaacggttcgtaactagtaacccgtttaagtttaaccgttaaagttaaccgggttcggggttccccggtaaggggttaacccgggtttaccggaaaccgggtaaaaccgggggtaaaccccggttaaaagggggtttaaccgggaaaaacccttaccgggtaaaaaaccggtccgggttaacggttcccgggtacccggttaaccggtaaacccgttaccctttaaacggttcccgtttttaaccccggg

SEQ ID NO: 103426 - DNA, 643 bp, Homo sapiens
  misc_feature: GYAE6OF01CT8ZN.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtcgtctccgaggggaaancgccaccctctctgcagggccagtcagagtgttggcagcaacttagcctgtaccagcagaaccgtggaccacggctacccgagtacgtcctcatctatcgctacactccgacgacgggcctactcgctacttccacgtccgtaggttcaggtcggaccgtaggtcgggtacgtcggggtacacggtagttaccacttcctaccgacctacgtcgacggacctacggtacccgttggcctaaggttcgtagtaacgtactttcgtacgtactttacttttattaccgttgtacgtaacgtactagttaacttaagttacggtcggttaccgggttggtaacccggttccggaccggtaaacgggaccgtaaagggtaacgtaactaacggtaaacgtaacgttcggtacggtacgtacggacctaacgtgttccgttacg

SEQ ID NO: 103427 - DNA, 638 bp, Homo sapiens
  misc_feature: GYAE6OF01EOCS4.34.34.D01.1.454.CMB.1.raw
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
  modified_base (618)..(618): a, c, t, g, unknown or other
  misc_feature (618)..(618): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgagggaaancgccaccctctcctgcgagggccagtcagagtgttggcagcaacttgcctggtaccagcaagaacctggaccaggctccgagacgtcctcatctatcgactacactccaccgacggccacgtgcctacttccgacgtccgtaggttcagggtcggcgtagggttcgggtcgtacgggactaggtacgtttcacttctacacctatcgacgcgacgtcctgactagtctaaggtaactcgtttccngttacccttaacgttttacttctcggtactaggtacctaggttacttaaaagtcggttacgggtccgttacgggtaccgttccgggaaccggtaaacgggaacccgttaaaggggtacggtaaaattaaccggaaaacgttacggttcggacggtaaccgtccgtaaaccncccgtaagttccgttaaccg

SEQ ID NO: 103428 - DNA, 637 bp, Homo sapiens
  misc_feature: GYAE6OF01BW9KQ.34.34.D01.1.454.CMB.1.raw
  modified_base (627)..(627): a, c, t, g, unknown or other
  misc_feature (627)..(627): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaagacgccaccctctcctgcagggccagtcagagtgttggcagcaacttagcctgtacagcagaacctggccaggcctccgagacgtcctcatctatgactacactccaccgacgggccactcgctacttaccagcctaggttcaggtgcgaggtgggtctagggactaggtacgtttccaaccgttcctaccgaaccctattccgacggtccaacggtccctacggacctacgggttactaacggaagttactttccgtacggtaccttaacttttactttactacgttacaacgtactaacgttacttaaacgttacggttcgggtaccggttagggtaccggttaccggacccgtaaaggggtaacccgtaaggggtaacgtaaacttacgaaacggtacgttggtaggtcctacgaccgtaccnttcgtaccgg

SEQ ID NO: 103429 - DNA, 660 bp, Homo sapiens
  misc_feature: GYAE6OF01ECOEC.34.34.D01.1.454.CMB.1.raw
  modified_base (206)..(206): a, c, t, g, unknown or other
  misc_feature (206)..(206): n is a, c, g, or t
  modified_base (297)..(297): a, c, t, g, unknown or other
  misc_feature (297)..(297): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagcccaccctgtctgtgtctccgaggggaaancgcccaccctctcctgcagggccagtcagagtgtggcagcaactgcctaggtaccagcaagaacctggccaggcctcccgagacgtccctnatctatcgcctacactcccaccgacgggcctaacgtcgtaccttaacttccgacgtaccgtacggttcagggtcggcgtagggtcgggtacgtggggaactaggtacgttaccacgttcctaccaaccataccgacgactacgtcccgtagccgtagttcctaggtaaacttctttcgtagtaccctttaacttttagtttaaccgttcgtacgtaacgtacctaaggttaccttaaaggttacggtcgggtaccggttacgggtacggttaccgggaccgtaaacggggtaaccggtaaagggtacggaaatacggtaaacggacgttacgggtacgtacgtacgaccaccgtgttcgtacg

SEQ ID NO: 103430 - DNA, 837 bp, Homo sapiens
  misc_feature: GYAE6OF01A0T80.34.34.D01.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggaagaaatagtgatgacgcagtctccagccacctgtctgtgtcnccgagggaanacgccaccctctcctgcgagggccagtcagtagtgtgcagcaacttacgcctggtaccagacaacgaaaccgtggacccacgggtcctaccccgaggtaccgtccctacgtaacttcctaagtcgtacctaacctactcccgaacccgtagggtacccaacgttacgtacctttaaacgttcccgaacggtcccgttaagggtttacccgaagggttcggggtacgtaaggggttcgggggttacctggggggtaacctaaacgggtacgtttcccgaacccgtttcctaacccgtaaccctaacgttacccgaaacggtcccgtaaccgggtccccgttacggtaccgtaaccgggttccgttaaacgggtaaaccgtttaacgttttccccgtaacggttacctttttaaacctttttaacgttaacccgttttaccgggtactaacgggtaacctttaaggtaacctttaaaaggtacgggtttacggacccgggtttacgggtaaccggtttaccgggacccggtaaaaacggggtacccggtaaaacgggtcgggtaaaaccgttaaccgaaaaccggttacgtggtaaccggtccgtacggtaaccaaccgttaagtccgtttaaccgg

SEQ ID NO: 103431 - DNA, 770 bp, Homo sapiens
  misc_feature: GYAE6OF01C8WDS.34.34.D01.1.454.CMB.1.raw
tcagtacacgtgatcacgaccggtgctcgatttagatcgtctgtgttgggtttgggggaggaactgctcagttaggaccagacggaaccatggaagccccagcgcagcttctcttcctcctgctactctggctccagacaccactggagaaatagtgatgacgcacgtctccagcccacctgtctgtcgtcgtccgaaggggaaacgacgcccaccctctcctgcgacgggcaggtacagaggtgttcggacacgactaacttacgccgtacggtaccagaccaacgtaaaccgtcggaccgaggaccctaccgaacgtaccggtcctacgtaactcgtacgttgggtcaccaccgtacccgaaccggacgggtaccctacgttcggtaccgtacccgaggtacgtaggtcggaggtcggacgtagggttcgggtacgcgggactaggtacgttaccgacgttctaccgactagtaccgacgcttacggtctacggacgttaccggtagtaaggttaaacgtttgttttagtaccgttttaagtttaaccttacgtcgttaaacgacgtttaaccttaaacgtttaaacgttaaagggtttaacccggtccggttaacccgttacccggttaacgttaccccggtacccggtttaaaccccggggacgtaaaaccgggtaacctaacggtacggtaaagggttaacgttaaaaaccggttaacgttacggtcgggttaccgtaccaggttaaccccgattcggttacccg

SEQ ID NO: 103432 - DNA, 809 bp, Homo sapiens
  misc_feature: GYAE6OF01D868E.34.34.D01.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtagtctaccgaggggaaanacgcccaccctctcctgcaggccagtcagngtgtggcagcaacttgcctggtaccagcaagaacctggccaggcctaccagtacgtcctnatctatgctacactcccaacgacgggcctagtgtaccttacttccaacgcctaggtttcgacggtgggacgtaggttcgggtacgtacggggaactaggtacgtttccaaccttctacccgaacctaactaccgaacggaccgtacggtcccgttacgaccgtaagttaccgtaacggtaaacgttccgtttaaccggttacgtaaccctttttaacgtttttaacgtttaacccgtttgggttaacccgtaaagggttaccgttaaaaggttttaacccgttttaaaacgttaacggggtttacccggggttaacccgggttaggggttaacccccggggtttaccggggaaaaccccggggtaaaacggggtaaacccggttaaaaccggggttaaaacggtaaaaacccggttaccggtaaaaaaaccggtaaaaccgttggggttaaacccgggttaccggttaacgtaaccccggttaaaccccgttagttttacccggttaacccgg

SEQ ID NO: 103433 - DNA, 735 bp, Homo sapiens
  misc_feature: GYAE6OF01DJJRH.34.34.D01.1.454.CMB.1.raw
  modified_base (203)..(203): a, c, t, g, unknown or other
  misc_feature (203)..(203): n is a, c, g, or t
  modified_base (716)..(716): a, c, t, g, unknown or other
  misc_feature (716)..(716): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaanagtccaccctctcctgcgacgggccagccagacgtgttacgcagctaacgttcggacctacggtaccagccaaggaaaacccgtggacccgacggggcctaccccgaagggcctcccgtcacgttcctaagttcgggtacgcctaacttcccgaacccggcggggtacccctacggttacgggtaccctaccccgaggtcccgtaacgggtttccgaagggtcggacgtacgggttcgggtaccgtacggggaactaacgtaacgttccaacttcctaccgaccctagtaccaggcccgtaacgtcccgtaggtaccctagttaccgtaaggtaaccgtttgtttacgtaacctttaggttttaaccttacgttcgtactaaggtactaagttaactaaacgttacgtccgggtacccggttaccggggtacgtccggaacgtaacggggtaccgtaggttacggaacttaaacggaacggtacgtcggtcgtacgttacggtaccaacgttnttcgtcgttccttaacccg

SEQ ID NO: 103434 - DNA, 722 bp, Homo sapiens
  misc_feature: GYAE6OF01E58J6.34.34.D01.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (704)..(704): a, c, t, g, unknown or other
  misc_feature (704)..(704): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcacgtctccagcccacctgtctgtcgtctaccgaagggaaacncgcccaccctctcctgcgacgggccagtcagngtgttgcagactaactagcctgaccagacaacgaaccgtcggaccacggcctaccgagtacgtccctactacttcctagtctaccactacctacccgaccggaacggtccactcgaccttacttcccgacgtcccgtaaggttccaggttcggacgtggttacgggtactaggggactacggtaacgtttccaccttacgtacccacgtacgaccacggacctacgtcccgtaggtactacggttctaaggaaacctttgtttacccgtagtttaccccgttttaaatttttacgttaccgtacggtaacttacggaacgttacgtttaaagttaaacggttacgggtccgggtaaccgttagggtaccccggtagggaaccccggttaaaagggaacggtaaacgggttagaaaccgtaacggtaaacccgggtagtttcccggaggtacccgtagtaacccnctttacgttcgttacccg

SEQ ID NO: 103435 - DNA, 709 bp, Homo sapiens
  misc_feature: GYAE6OF01EDGK2.34.34.D01.1.454.CMB.1.raw
  modified_base (213)..(213): a, c, t, g, unknown or other
  misc_feature (213)..(213): n is a, c, g, or t
  modified_base (480)..(480): a, c, t, g, unknown or other
  misc_feature (480)..(480): n is a, c, g, or t
tcagtacacgtgatcacgaccggtgctcgatttagatcgtctgtgttgggttgggggaggaactgctcagttaggacccagacggaaccatggaacgccccagcgcagcttctcttcctcctgctactctggcctccagaccaccacgtggaagaaatagtgatcggacgcagtctccacgccacctgtctgtcgtacgtacgaaggggaacncgccaccctctctcgcgacggccagtcaggtagtcggtcgcacgactaacgtcgccgtacggacagaccgaacgaaccgtcggaccgaggtccctaccgaacgtccgtcctactacgtacttacgtcgtacctacacctacccgaccggacggacctacgttcgtaccttacgtccgacgtaccggttacgtcgacggtcggacggtagggtcggtcgtagggactacggtaccgttacacgtaccaccgtaacgagtacccggacnccgtcgtccgttgacgttacgtacgtagtacttcttacgtctactttaactttcgtacgtcgacgtacgtactaacgttacgtaacggtacgggtccggtacgttacgggtacggtaccggaaaccggtaaacggggtaaccgtaaacgggtaacgtaaaaccgttaacggaaacgggttcgttcggaccggtacgttacccggaacttaccggttgttcccgttaccg

SEQ ID NO: 103436 - DNA, 578 bp, Homo sapiens
  misc_feature: GYAE6OF01B1B75.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactgggagaaatagtgatgacgcagtctccagcccaccctgtctgtgtctccgaggggaancgcccaccctctcctgcagggccagtcagatgttggcagacaattagcctggtaccagacagaaacctggaccaggcctcccgagacgtcctcatctatcgctacataccaccagggccactgctatccagccaggttcagtcggcaggtgggtctgggactagtacgttcactcctacaccatcagcacgtccctgcgtagtccgtagaacgtactttcagtcctaacttttaatacgttcgtactaggtcctagtacttaaggttacgtcggtccgtaggtaccgttccgggaacctaacgggaacgtaacgggtagtaaacgtacgaaacgtaccgtaggtaccggacgttcgactaccgtgtcgttacg

SEQ ID NO: 103437 - DNA, 789 bp, Homo sapiens
  misc_feature: GYAE6OF01A7HPR.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactactcagttaggacccagacggaaccatggaagccccagcgcagcttctcttcctcctgctactctggctcccagacaccactggagaaatagtgatgacgcagtctccagccaccctgtctgtgtctccgaggggaaancgcccaccctctccgtgcgacgggccagtcagtagtgtgcagactaacttgccgtaggtaccagacaacggaaaccgtcggaccgacggcctacccgaggtaccgttccctacacgttactacgttcggtaccttaaccgaaccttaccccgaaccggaccggggtaccctaacgttcgtacctttaaccgttacccaacggtcccgtaacggttcgaagggtcgacgtgggttacgggtccgtagggactacgggtacttaccgaccttacctaccgacctactaccgacgccgtacgtaccgtcgtaccgaacggttacctaagggtaacttacgtttacgtacgtaccttttaacttttacgttacggttacgaccttaggtaccgttaacgttaacctaagggtttaaccggtcgggttaccgggttaccgggttaccgggttaaccggaaaccggggtaaaccggtaacccggtaaaaggggttaaaccgtaaacgttaaaccgggaaaacggttacggttaccgggtacggtacgttaaccggtacttaacccggttacttccggttaccgtttacccg

SEQ ID NO: 103438 - DNA, 640 bp, Homo sapiens
  misc_feature: GYAE6OF01ANVFF.34.34.D01.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccaggggaangccaccctntcctgcgagggccagtcagagtgttggcagcaacttagcctggtaccagcagaaacctggccaggcctccagacgtcctcatcatgctacactccaccgngggtcccacgtgcctattccagtccgaggtttccgagtcgcgtaggtgggttcgtggggactagtacgtttcacttccgtccaaccatcacgactacgtccctggactaggttaccagtaacgtatttcctacgtaccttaacttttacttaaccgtgttaccgagtacctaaggttacttaaacggttagtcgggtacccggttagggtaaccgtttccggggaacccgtaaacggggtaacccgtaaaggggttaccggtaaaagtacccggtaaaacggtaacgttcgggttaccggtacgtacgacccgtaacctgtccgttccgg

SEQ ID NO: 103439 - DNA, 659 bp, Homo sapiens
  misc_feature: GYAE6OF01AXCMO.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctctccctcctgctactctggctcccagacaccactggagaaatagtgatgacgcagtctccagccaccctgtctgtgtctccgaggggaaangccaccctctcctgcagggccagtcagagtgttgcagcaacttagcctggtaccagcagaacctggccaggcctccgagacgtcctcatcgtatcgctacactaccaccgtagggcccacgtgactacttcccgaagtccgaggtttcaggttcggcgtaggtcggggtcctaggggacaggtacgttccgaactcctaccgacatccgagctacgcccgtgcctacgttcgagtaacgtacttctacgtaccgttaactttacttacgtgtacgaacgtaccgttagttaccttaaaggttaacggttcgggtaccggttagggtacccggttaccgggaacccggaaacggggtaacccggtaaaggggtaacggtaaaacgtaaccggtaaaaccggtacgttagggtaccgggtaccttacggaaccctaacccggtagttcccgttacgg

SEQ ID NO: 103440 - DNA, 785 bp, Homo sapiens
  misc_feature: GYAE6OF01A21MX.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtcctccagcccaccctgtctgtgtcctccgaggggaaagcgcccaccctctcctgcgagggccagtcagtagtggtggcagctaacttagcctaggtaccagacaagtaaacccgtggaccacggccctcccgaagtaccgtccctacgtactccttagtacggacctaaccgactaccccgaacccggacggggtacccctaacgtacggtaccttaaccgtttacccacggtaccgttacgggtttcaagggtcggccggtaagggtacggggtcgtaggggaaccgtaaggtaccgtttaccaccgttcctacccgtaacctacgtaccgtacgccgtaacggtccctaggaccgttaacggtacgtaacggtaaacgtctttaccgacgttaaccttaacctttttaagttaccgttgtaaccgtagttaaccgtacggtttaaacgttaagggtaacgggttccgggtaccgggttagggttaaccccgggttaccgggaaacccggtaaaccgggggtaaaccgtaaaggggtacgttaaaaccgtaccggtaaaacgtacgggttaggtaccggtacctaacggacccctaacgttgtttccccgttacg

SEQ ID NO: 103441 - DNA, 786 bp, Homo sapiens
  misc_feature: GYAE6OF01BEZLK.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccacctgtctgtcgtctccgaggggaaancgcccaccctctccgtgcagggccagtcagtaggtgttggcagcaacttcgcctggaccagacaacgaacctggccaggcctccgagacgtccacatctatcgctaaccactacccgacgacgggaccctagtcgaccttactacccgaacgtccgtaaggtttccagggtcggacgtagggttggggtacgtagggggactacggtcgtttccaaccgtctaccaactacgtacgacggtcaccggtccctaggaccgtaagtccgtaaggtaacgtttactttaccgtacggttaccctttaaccgttttttacgttaaccgtttacgggtactaacgggtaaccgttaacggtttaaacccggttaaaaggtttaaccgggtccggggtttaaccgggttaacggggttaacccccgggtttaaccgggggaaacccggggttaaaaaccgggggaaaccgggttaaacgggggtaaaccggttaaaaaccgttaaacccgggtaaaaacgggttacggttacgggtaacgggtaccgtacgggtaacccttaaccgttaccggttaccggttttacg

SEQ ID NO: 103442 - DNA, 673 bp, Homo sapiens
  misc_feature: GYAE6OF01BGIE1.34.34.D01.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtcgtctccgaggggaaacgngccaccctctcctgcagggccagtcagagtgtgcagcaattagcctggtaccagcaagaacctggccaggcctccagtacgtccctcattcttaancgactacactacccaccgtacgggcccactcgtaccctacgtttacccgagaccccgtaaggttaccgacgggtcgggacgtaggttcggggtacgttacgggggaactaggtacgtttacaccgttctacccgtacatccgaacgcgactcccgaggcctaacgttactaggacgtactttcgtcgtacttaaccttttacgtattccggtactacgtacgttaacgtttaacttaaaggtacggtttcgggacccgttaggggtacccggttacggacccggtaaggggtaacctaaagggaggtaaaacctaccgaaaccgggtagttcggtacggcgttacccgacgaccctagtttccggtacg

SEQ ID NO: 103443 - DNA, 617 bp, Homo sapiens
  misc_feature: GYAE6OF01AP121.34.34.D01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgccaccctctcctgcagggccagtcagagtgttggcagcaacttagcctggtaccagacagaaacctggccaggcctccagacgtcctcactctancgactacactaccaccgacgggccactcgactacttccacgccgtaaggttcagttggctaggtcgggtcgtagggacaggacgtttcactcctcaacatcagcacgcctgctacgtctagagtactttcgcgtacttaacttttacttacttcgtactacgtactaagtttacttaaaggttaagggtcggtaccgggttacggtaacgggttccgggaaccgtaaacgggacccggtaaaagggtcggtaaaagtaccgaaaacgggtacgttagggacgggtacttacgaaccgtacctaacgttcgttaccg

SEQ ID NO: 103444 - DNA, 267 bp, Homo sapiens
  misc_feature: GYAE6OF01BGRWW.34.34.D01.1.454.CMB.1.raw
  modified_base (237)..(237): a, c, t, g, unknown or other
  misc_feature (237)..(237): n is a, c, g, or t
  modified_base (254)..(267): a, c, t, g, unknown or other
  misc_feature (254)..(267): n is a, c, g, or t
tcagtacacgtgatcacgaccggtgctcgatttagatcgtctgtgttgggtctgggacagagttcactctcaccatcagcagcctgcagtctgaagattctgcacttttattactgtcagcagtctaataagtggccgtggacgttcggccaagggaccaaggtggaaatcaaacgaactgtggctgcaccatctgtcttcatccttcccgcatctgaatcacgtgtactgagcggntggcaaggcgcagtagnnnnnnnnnnnnnn

SEQ ID NO: 103445 - DNA, 811 bp, Homo sapiens
  misc_feature: GYAE6OF01CY3T8.34.34.D01.1.454.CMB.1.raw
  modified_base (205)..(205): a, c, t, g, unknown or other
  misc_feature (205)..(205): n is a, c, g, or t
  modified_base (363)..(363): a, c, t, g, unknown or other
  misc_feature (363)..(363): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagaccaccactggagaaatagtgatgacgcagtctccagccaccctgtcctgtgtctccgagggaaangccaccctctcctgccagggccagtcagagtgttggcagactaacgttacgccgtaggtaccagtacaacgaaacctcggaccacggcctaccccgaaggtacgtcctacgactttctatcgtactacacttacccgaccgtacgggccctaaccgtntaccttaccttaccgacggtaccgtaggtttaccaacgggtcggacgtaacgggttggggttaccgtaggggtaaccctagggttaacgtttacccaccgtttccgaccctaaccgtaacgttaccgaaccggtacccgtaacggttccccgtaggtacccgtacggtttcgtaacggtaacgttactttccgtaccgttaaccttttaaccgtttttacttaaccggttacgttacctaacggtacctttaacggttaaccgttaaaggttccgggttacggtacccgggttacggtaacccggggtttacccggaaccgggtaaaccggggtaaccttaaaggggggtaaccgtaaaccggttaaaccggttaaaaccggtaccgttacgggttacccggtaccgtttaaccggacccctaaccgtttaacgttccggtttaaccg

SEQ ID NO: 103446 - DNA, 707 bp, Homo sapiens
  misc_feature: GYAE6OF01DX3G0.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccacctgtctgtcgtctccgaggggaancgcccaccctctcctgcgagggccagtcagtagtggtggcagactaacttacgccttggtaaccaggaccaacggtaaaccgtggacccaggcctacccgagacgttcctacattctagtcactacgactacccacggacggcctatcgtactactccaagtccgtaaggttcaggtggaccgtagggtcgggtcacggggtaacacgggtacgttccaccttacctacccgaaccgtacttacggacgaccgtacggtcccttaggacccttaggttacctaaggtaactttcgtttactacgttaacctttaacgtttttacgtaccgttcggtaaccagttaccgtaaggttaaccttaaaggttacgggttcgggtacccggtaggggttaacccgttccgggaaccggtaaacggggtaaccgttaaaggggtaaccgtaaacgtaaaccggaaacgtaggtcggtacggtactaccggacctacgttgtcgttaccg

SEQ ID NO: 103447 - DNA, 631 bp, Homo sapiens
  misc_feature: GYAE6OF01BJ8BN.34.34.D01.1.454.CMB.1.raw
  modified_base (205)..(205): a, c, t, g, unknown or other
  misc_feature (205)..(205): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (410)..(410): a, c, t, g, unknown or other
  misc_feature (410)..(410): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaatagtgatgacgcagtctccagcccaccctgtctgtgtctccgaagggggaanacgcccaccctctcctgcgacggccagtcagagtggttgcagcaactagcctggtaccagcaacgaaccgtcggccaggccncccgagacgtccnctatctatcgacctacgactacccgaccgacgggcccactcgtactactaccacggcctaggtcaggtgcgaggtcgggtcgtaggagagtcgtcactcgtaccactacncacgacacgtcctgactacgtcgtacggagttattcgtacgtacctttacttttacgttactttacgtcgaacgtacgttacgttacgtaaagttacgggttcggtaccggttacggtaccgggttaccggacggtaaaccgggtaacggtaacggtaacggtaaagacggtaaaccggacggttggacggtacctacgaccgtctaagttccgttaaccg

SEQ ID NO: 103448 - DNA, 609 bp, Homo sapiens
  misc_feature: GYAE6OF01B583B.34.34.D01.1.454.CMB.1.raw
  modified_base (178)..(178): a, c, t, g, unknown or other
  misc_feature (178)..(178): n is a, c, g, or t
  modified_base (186)..(186): a, c, t, g, unknown or other
  misc_feature (186)..(186): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (520)..(520): a, c, t, g, unknown or other
  misc_feature (520)..(520): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
tcagtacacgtgatcacgaccggtgctcgatttagatcgtctgtgttggggtttgggggaggaactgctcagttaggacccagacggaaccatggaagccccagcgcagccttctcttcctcctgctactctggcctcccagacaccacgtaggaagaaatagtgatgacgcacgtcnccagcccncccttggtctgtcgtacgtccggaaggggtaaacncgaccctaccctctcgcgacgacgggtccagtnaggtgtggttgacagactaacgttcgcttacggaccacgactaacgaaccgnggaccgtaacggtcccacgaacggtacgtcctaactggtactaggtcacctacgactccgacgtacggccactntacctatcgacgtcggtaactttgaagggnggtacgtcgggtcgggtatacgggactacgtcgttacaacctcggacaccnggtacacgnactccganatcgattggaatcttcctagtaccttagtttataccgttganacgtatacgttaagtacgtagttcggacgttggacccgttgaccgagacgtaagactaanaccgnttacgngacgtnacgatngtntac

SEQ ID NO: 103449 - DNA, 794 bp, Homo sapiens
  misc_feature: GYAE6OF01CG8HF.34.34.D01.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagtacacgtgatcacgaccggtgctcgatttagatcgtctgtggttggggtttgggggaggaactgctcagttaggacccagacggaaccatggaacgccccagcgcagcttctcttcctcctgctactctggctccagacaccactaggagaaatagtgatgacgcagtctccagcccacctgtctgtcgtcnccgaagggaacncgcccaccctctcctgcgaggccagtcaggtgtggtgacagactaacgttacgccgtacggtaccagaccgtaacgaaccgtcggacccaggtccaccgtagccgtcctcacgtctagtcgactaccactaccgacgacggacctacgtcgtacttactaccgagtccgtacggttcgaggtcggacgtaggtcgggtacgtagggaacgtggtacgttccaacgtccgacctacctactaccacgtacgacgtaccgacgttttttttttacgacggtacgtaacgtacgtacgttacgttacgttactttacgtttacgtttacgttacgttacgtaacgtacgttaaccggttaaccgttaaacggttaacgggttaccgggttacccgggttacggggttaacccggggttaacccgggtaaacccgggtaaaccggggtaaaccggggtaaacggggttaaaccgggtaaaaccgggttaaaaccggttaaaacccgggttaaacccgggttaacgggttaaccgggtaacccggtaacccggtacccgttaacccgttaaccgttaccggtttaacccgg

SEQ ID NO: 103450 - DNA, 656 bp, Homo sapiens
  misc_feature: GYAE6OF01B25IN.34.34.D01.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (645)..(645): a, c, t, g, unknown or other
  misc_feature (645)..(645): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgcccaccctctcctgcgagggccagtcagngtgtggcagcaattgcctggtaccagcagaacctggccaggctcccagcgtcctcatctatgcctacactcccaccgacgggccacgtgactacttccagcctaggttcaggtcggcaggttcgggtctaggggactaggacgtttcacgttctcgaccatccacgcacgtccctgaccgtaggttacctaggtaacgtactttccgtacgtacctttaacctttttatttaccgttcggttacctaacggtactaaggtttaccttaaagggttacggttcggggtacccggttacggggtaccggtttccgggaacccggtaaacggggtaaccctaaaggggttaccggaaacttaacccggaaaacggtacgttagggtacgggtccttacggaacccctacgtnttcccgttacg

SEQ ID NO: 103451 - DNA, 630 bp, Homo sapiens
  misc_feature: GYAE6OF01ESIGB.34.34.D01.1.454.CMB.1.raw
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagtacacgtgatcacgaccggtgctcgatttagatcgtctgtgttggggtttgggggaggaactgctcagttaggacccagacggaacatggaagccccagcgcagcttctcttcctcctgctactctggcctcccagacaccactggagaatagtgatgacgcagtcnccagccacctgtctgtgtctccgagggaangccacctctcctgcacgggccagtcagagtgtgcagcaacttgcctggtaccagcagaacctggccaggctccagagtcctcatctagtgctacactccacacgggccactgctatccagccagttcagtgcaggtcggtcgtagggacacggtagttcaacgttatcctaaccngttacccgaggaccgtaacgtcccgttagacctaaggttcctaacggaacggttaatttccgtaaggacctttaacgtttttacgttaaccgttggttaacgacggtactagggttaacctaaagttaacgggtcggtcccgggttacggttaccgttacgggacccgtaaaggggtacccgtaaagggttacggaaataccggaaaacggtaacgttcggtacgggtacctaggacctaacgtagtcgttacg

SEQ ID NO: 103452 - DNA, 652 bp, Homo sapiens
  misc_feature: GYAE6OF01A5BQ3.34.34.D01.1.454.CMB.1.raw
  modified_base (435)..(435): a, c, t, g, unknown or other
  misc_feature (435)..(435): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaagcgccaccctctcctgccagggccagtcagtagtgttcggcagcaacttgccgtggtaccagcaacgaaaccgtggccaggcctaccccgaggtacgtcctctactctagtcgacctacactcccaccgacgggtcccacgtcgtacttacttcccgagtcccgaaggttccagggtcggcgtagggtcgggttacgtggggactaggtacgttcaccttcgtaccacctntaccacggccacggtccctggactacggtctagtaacgtattctagtccttacttttataccttcgtcgtaacgtccgtaagttacgttaaaggtacggtcggtacgggttacggtacggtcccgggaaccggaaacgggtaaccgtaagggtaccggaaacgttaccggaaacgtaacgtcggtacggtctacgaaccctacgtcgttcgtaccgg

SEQ ID NO: 103453 - DNA, 733 bp, Homo sapiens
  misc_feature: GYAE6OF01CK0Q0.34.34.D01.1.454.CMB.1.raw
  modified_base (297)..(297): a, c, t, g, unknown or other
  misc_feature (297)..(297): n is a, c, g, or t
tcagtacacgtgatcacgaccggtgctcgatttagatcgtctgtgttgggttgggggaggaactgctcagttaggacccagacggaaccatggaacgccccagcgcagcttctcttcctctgctactctggcctccagacaccactaggagtaaatgtagatcggacgcacgtcctccacgccctacctgtctggtcgtccaccggaagggaacgaccgcccaccctctccgtgcgtacgggccaggtcgaggtaggttggttcggctaacgactacgttacgccgtacggaccganacaacgtaaccgtcggacccaggtccctaccgacgtccgtaccactattccgtagtcgtactaccgacgtacccgacggacggtacccacgttcggacccttaactcccggactccggttacggttcgacgggtggtaccggtacgggttcgggttcgaacgggtacgtaaggttaccgttacctacctttacccaaccgtaccgtactaccggtacggacctaccgtcgtaccgtacgtacgtaacgtagtaacgttcgttacgtacgtaccctttagtttacgtacgttctacgtacgtagtacgttaacgttaggtacggttccggtacggacggtttaccggtaccggaacgggtaaaccggtaaccgtaaggtaaccggtaaacacggtaaacgtggttacggacgtcacgtccaacgttcgttcgtaccg

SEQ ID NO: 103454 - DNA, 704 bp, Homo sapiens
  misc_feature: GYAE6OF01BEIAQ.34.34.D01.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctactctggctcccagacaccactggagaaatagtgatgacgcagtcncagccacctgtctgtgtctacggaagggaaccgccctaccgtctcngcagggccaggtcaggagtggttggacagactaattaggccttaggaccagcaacgaacctgggaccaggccctacagtacgtcctacattacacttgacctacgtaccacccgaacggcggtacctggtcttactacgttcccaacgtccgtaacggttcacgggtcggtccgtagggtttcgggacgttacgggaactagggtctttccaacgttccaaccgtactacgtacgtaacgacgtaccgttacgtcgtaaccgtacgttacgtaaccgtaagttacgttccgtaacgttacttaaccgttttaactcgtttacggactacggtactaagttacgtaacgtaagggttccggtaacggtaggtacccggtacggtaaaccgggtacggtaacggtaaacgggtaacggtaaaccgtaaccgtaaaacggtcggtaacggaccggtacgttacccgaccgtacttaggttcctttaaccgg

SEQ ID NO: 103455 - DNA, 741 bp, Homo sapiens
  misc_feature: GYAE6OF01AK99B.34.34.D01.1.454.CMB.1.raw
  modified_base (225)..(225): a, c, t, g, unknown or other
  misc_feature (225)..(225): n is a, c, g, or t
  modified_base (736)..(736): a, c, t, g, unknown or other
  misc_feature (736)..(736): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagaccaccacgtggaagaaatagtgatcggaccgcacgtcctaccgacgccctacctgtctgtcgtcctaccggaaaggggaaacnccgccctaccccttctccgtggaccgacgggccctaggtacgaaggtggttcggtacggaccaacgaccttaaacgttcggacccgtacggtaaccgacgaccgaaacggtaaccgtcggacccgaacggtccctacccgagtccgttcctatacgtacgtagtccgacttaccaccgtacccgaccggacgtaccctacgtctaccgttactacccgacggtaccgtaggttccgacgggtcggaccgttaggggttcggtacggaggaaccgttacggttacccttccaaccgttcctaacccgaacgttgtaccgacggtccaaccgttccgtagtacgtacggtacgtacgtagttcctttcgacttacgtttaattcgtacgacgtcgagttacctagttaccgttaaaggcggttccggtacgttacggtaccgtaccggaacggtaacgtaacggtaagaaacgttacaaccggtaggtagtcgaccgtcacctgacttcgttntccgg

SEQ ID NO: 103456 - DNA, 846 bp, Homo sapiens
  misc_feature: GYAE6OF01CES34.34.34.D01.1.454.CMB.1.raw
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatgtgatgacgcagtcnccagcccaccctgtctgtgtctccgaaggggaancgcccaccctctccgtgccgacgggccaagtcaggtagtgtggcagacaacttgccgtaggtaccagacaacgtaaaccctcggacccgacgggtccctaccccgaggtaaccgttccctctaactttcctattcgaccttaacaccgtacccgaaccgacgggtccctaacgttcgaccttactacccgacgtacccgtaggtttccgaagggtcggacgtagggtcgggtacgtagggaactagggtacttcaccgttacctacaaccgtagtccgaacgaccgtaccggtccgtacggaccttacggttacgtaacggtaacgttaccgttttactacgttaacccttttaagttttaacgttacgtttacgtaccgaaggttacccttaaaggtttaaccgttaaacggtttaaccggggtacccggggttaccgggtttaccggggttaacccggtttacccggggaaaacccgggttaaaacgggggaaaaacccgggttaaacgggggttaaaaccggttaaaacccgttaaaacccgggttaaaacccggggttaaccggtttcgggttaacccggggttaaccgttaccccggtaaacccgacggttttaacccgttcggttttaaaccccgg

SEQ ID NO: 103457 - DNA, 908 bp, Homo sapiens
  misc_feature: GYAE6OF01AB2P5.34.34.D01.1.454.CMB.1.raw
  modified_base (163)..(163): a, c, t, g, unknown or other
  misc_feature (163)..(163): n is a, c, g, or t
  modified_base (207)..(207): a, c, t, g, unknown or other
  misc_feature (207)..(207): n is a, c, g, or t
  modified_base (591)..(591): a, c, t, g, unknown or other
  misc_feature (591)..(591): n is a, c, g, or t
  modified_base (602)..(602): a, c, t, g, unknown or other
  misc_feature (602)..(602): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctactctggcctccagatactactggagaatagtgatgacncagtctccagcccaccttgtctcgtcgtcccggaaggggaaacncgcctacttcctctcgtgacgcgggccagtcagtaagtatacgacctaactaacgttcgccgttacgtaccaggaccaaacgtaacccgtcgggaccctaaacgacccgttaccccggacggtaccccttacccgtaactacgttttacggtaacggtttcggacgtaacccgtacccgttaccccggaacccggtaaccggggttaccctaacggggttttaccgaacccggttacccccgggagggtaccggttaacgggtttttaccgaaaccggggtttcggggaaccgggttgggggtttacccggggttacggtaccgggggtaaactaccggggtttaaccgtttaccctaacccgttaccgtacccggttaaaccncggttaaaccnccggtacgtacgtttacgaccgggtacgtaaccgttcggtaaacgggtactttcccgttaagtactttaacccgttttattttaaaccgtcgtttagtaacccggtcttaaacgtggttttaaaccgtaagggttccggttaaccgggggacccggttcggggtttaaaccccgccggggtaaaccgggttaacccgggaaagtttaaaccgggtaacggtaaacgtaaaccggtaacgggtttaactcggggtacctacggttacgacccttacggtaacttccggtttaccgtagttaaccccg

SEQ ID NO: 103458 - DNA, 610 bp, Homo sapiens
  misc_feature: GYAE6OF01DKHVT.34.34.D01.1.454.CMB.1.raw
  modified_base (205)..(205): a, c, t, g, unknown or other
  misc_feature (205)..(205): n is a, c, g, or t
  modified_base (599)..(599): a, c, t, g, unknown or other
  misc_feature (599)..(599): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaaancgcccaccctctccgtgcgagggccaagtcagagtcgttggacaggacaacttgcctggtaccagcagtaaacctggccaggctcccgagtacgtcctcaatctatgacctacatacccacgacggccaactgacctattccaacgcctaggttcagtcgcaggtggtctggacaggtacttcacttctacaaccattccgagcctaggccctgaccagtatgaacgtattccgtgacttacgttttacagttgtacgaagcctagttacctaaagttaacggtcggtaccgtagggttaccggttacgacccggttaaacggggaacccaaaggggtaacgtaaaagtcccgtaaaacggaccgtttggacggtctaaggaccctaaccggtnttccgttacgg

SEQ ID NO: 103459 - DNA, 760 bp, Homo sapiens
  misc_feature: GYAE6OF01A324O.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatcgcccccggagaaattgtgttgacgcagtcgccagaccaccctgtctctgtctccgaggggaanacgccaccctctcctgcgagggtcagtcagtcgttactaacaccgtacttcttcgcctggtaccagcagacgacctggccacggcctacccgaggtcctcctctattccgtttggtcgccgtacccaccgacggggaccctacgtcggacctacgtaccccgaaggaccgtacgggtttacaacgggttcgggacgtaacgggttcgggggtaccgtacggggtaaccgtaacggtaccctttaccgacccgttcccgttaccgaaaccttacgtccgaacgggtaccgtaacggttaccgtttacggaccgttacccgttaaggttaaacgtttacgttttaggaacctttaaggttaactttaacgtttaaccgttacggttaccgtaaccgtacttaaacgtcgttacggaacgtaccgtacgtacgttcgggtacgggtaccggtaccggaccgtaacgggtaacgtaagggtacggtaaacgtaaccggaaacggtaagtcgggtacggtacgtacgacctacgtacttacgtcgttccgttactacccg

SEQ ID NO: 103460 - DNA, 804 bp, Homo sapiens
  misc_feature: GYAE6OF01EMFR3.34.34.D01.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctcgagggaangccaccctctcngcgagggccagtcagagtgttggcagctaacttagcctggtaccagacaaggaaacctggaccaggcctaccgagtacgtcctacacgtctaatcgactactacctacccaccggacggtccacgtcgtacctacttccgacggtaccgtaacggttcgaagggtcggtaccgtaggggttcgggtacgtcggggaactacgggtacgtttacccgacgttccgtaacccgaaccgtacgtaccgaacggcctaaccggtccgttacggaccgttaacggttcgtaaacgggtaacgttcttttacccgtacggttaccttttaaccgtttttaacgtttacgtcgttaccgtaacgttaccgttaaacgtttaacgtttaaaacggttaccggggtttacccggggttaacccggggtttaacggggtaccccgggttttaaccgggaaacccgggtaaaaccgggggtaaacccggttaaagggggttaaccgtaaaaacgttacccgggaaaaaccggttaccggttaggggttacgggtacccttaaccggaaccccgttaacggttaaccgttccggtttaacccg

SEQ ID NO: 103461 - DNA, 783 bp, Homo sapiens
  misc_feature: GYAE6OF01C6110.34.34.D01.1.454.CMB.1.raw
  modified_base (151)..(151): a, c, t, g, unknown or other
  misc_feature (151)..(151): n is a, c, g, or t
  modified_base (220)..(220): a, c, t, g, unknown or other
  misc_feature (220)..(220): n is a, c, g, or t
  modified_base (769)..(769): a, c, t, g, unknown or other
  misc_feature (769)..(769): n is a, c, g, or t
tcagtacacgtgatcacgaccggtgctcgatttagatcgtctgtgttgggtttgggggagaactgctcagttaggacccagacggaccatggaagccccagcgcagcttctcttcctcctgctactctggcctcccagacacctatagganaaatgtgaatcggaccgcagtcctccgacgcccacccgttgtctggtgttccaccggaaggggaaaacncgccctacccgtctcccgtggacgaacgggccctaaggcgaggtaggttggtacggactaaggaccttaacttacggaccgttaggtaccgacgaccgaaacggtaaacccgtcgggaccgaacggggtcccttacccgaaaggtccttaccccgtactaaccgttccttaacgttccgaacctaacctaccctacccgaccggtaaccgggacctaccgtcgtaccttaccggttaccacggtaccgtaggtttaccgacgggttaggaccgttagggtcggggtccggtaggaaccgtaacggttacctaccgaaccttactaccgaactaccttaccgagtaccgtaacgtcccgtgacgttacgtaacggaaggtacttacgttcgtactaccttttatttactacggttacgtgaacctagtacgttaacgtaagtacggttcgggacgttacggtaccggtacggaaaccgaagggtaccctaaaggtaacggaacgtaaaccggtaagaccggtttaggacggacctttaacgaccgtaacncgtttcgtaacccg

SEQ ID NO: 103462 - DNA, 765 bp, Homo sapiens
  misc_feature: GYAE6OF01ED9VO.34.34.D01.1.454.CMB.1.raw
  modified_base (207)..(207): a, c, t, g, unknown or other
  misc_feature (207)..(207): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggagaaatagtgatgacgcagtctccagccaccctgtctgtcgtctaccgaaggggaaanacgccctaccctctcctgcgacgggccagtcagtgtgtggcagctaacgttacgccgttaggtaacccaggaccaacggtaaaacccgtcgggacccacgcccctacccaacgtaccttcccttacgtactttccggttttcgggtcgacccgttacccgaaccggacggggtccctaacggttccggacctaaccgtaccccgtaaggaccgttagggtttccgagggttcggacgtaggggttcgggtacgtacggggacctacgtaccttccaccttccgaccaacctagtaccgaggtcggtacttaggacgtaccgtaggtaacgttacgtttacgacgttaagttaactttaacgttacgttacgtacgtacgtaactaagtacgtaccgtaacgaccgtacgtacggttcggggttaccgggtaccggtttacccgggaaccggtaaccggggaaccggtaaagggtaacggtaaaaccgtaacgtaaaccggtaacgttcgggtacggtacgtacgtacctaaccgttacgtcgtttacgtcttaacccg

SEQ ID NO: 103463 - DNA, 739 bp, Homo sapiens
  misc_feature: GYAE6OF01C7GOS.34.34.D01.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
  modified_base (212)..(212): a, c, t, g, unknown or other
  misc_feature (212)..(212): n is a, c, g, or t
  modified_base (580)..(580): a, c, t, g, unknown or other
  misc_feature (580)..(580): n is a, c, g, or t
  modified_base (716)..(716): a, c, t, g, unknown or other
  misc_feature (716)..(716): n is a, c, g, or t
tcagtacacgtgatcacgaccggtgctcgatttagatcgtctgtgttggggtttgggggaggaactgctcagttaggacccagacggaaccatggaacgccccagcgcagcttctcttcctcctgctactctggcctccagacaccacgtgggaanaaatgtgatgacgcagtccnccacgcccacctgtctgtcgtcaccggaagggaaanccgccctaccctctccgtggacgcgggacctaggtacaggtgttggtggacagactaacgttacggccgtacggtaaccagaccgaaacggaaaccgtcgggacccgacggccctacccgacggtaccttccgtactaactccgttagtccgaacctaaccaccgtaccccgaacccgggaccggccctacgttctaaccgttacttacccgaacgtaccggtaacggttcgaacggggtcgtacgtaggggttcggtacggtaggaactagtaccgttccaccttccgacacgactacgacgccgtacgtacctggaacttaggtacgttaagaacttctttacgtacgtaacttttaaacgttttntaccgtatacggacgtaacctagttaaaccggtagttaacgggtcgggtaccgttagggaccccgtagggaaaccggaaccggggtaaactaagggtaaccgaaaacaacggtaaaccggtaggtcggacggtacncgaacccgtatccgtacggtttc

SEQ ID NO: 103464 - DNA, 798 bp, Homo sapiens
  misc_feature: GYAE6OF01E06PD.34.34.D01.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagactaccagtggaanaaatagtgatgacncagtcnccagccctacgtgtctgtcgtctaccgaaggggaaancgtccaccctctccngcgacggccagtcagngtgtgcagctaacgtacgccgtacggtaccacgacgaacgaaccgtcggacccgacggtccctacccgaacggtaccgtacccttactacgttaccttaacgttaacgtaccggtaccgttaacgtacggccggtaaccgggcccgttaacgggtcccgggtaccccgtaacccgaaggtaacccgttagggttacgacggttacgggacggttaggggtcgggtcgggtacggggactacggttacccttaccgaccgttaccgtaccctaaccgtgtaccaacgggtaccgtaggtaccggtacgggacgtaacccggttaaggggttaactttacggtttacggagttaacggtttagttaacgtttaccgtacgtttaaccgtaacggttcggtttcggtaccctaacgtaccgtaacggtccgggttacggttaacccggtacgggaaaccgtaacgggtaaccgtaaacgggaaacgtaaaccgtaacgtaaacgggtcgtagggtaccgacgtacggaaccttacgtattcccgttagtaccttcccg

SEQ ID NO: 103465 - DNA, 597 bp, Homo sapiens
  misc_feature: GYAE6OF01BJXM3.34.34.D01.1.454.CMB.1.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggctcccagacaccactggagaaactagtgatgacgcagtctccagcccaccctgtctgtgtctccgaggggaaancgccaccctctcctgcagggccagtcagagtgtggcagcaacttagcctggtaccagcacgaaacctggccaggctccagctccncatctancgctacntaccacgagggcccatgactactccgagcctaggttcaggttcggcgtaggtggtcgtagggactaggtacgtttcacgtctaccacctatcagcgaacgccctagcctaagtccgtagaacgtnttccgngtaccttaactttacttactcgtacagtcctaagttcctaaagtacggtcggtaccgtaggtaccgttcgggaccgaaacgggtaccgtaaagggtacgaaactaaccggaaaacgtacgttggtacggtacctcgaccctacgttacgtccgttaaccg

SEQ ID NO: 103466 - DNA, 779 bp, Homo sapiens
  misc_feature: GYAE6OF01E44GT.34.34.D01.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcttccagacaccactggaagaaatagtgatgacgcagtctccagccaccctgtctgtgtctcgaggggaaanacgcccaccctctcctgcagggtcagtcagtcgttctaacnccgtactttctcgcctggtaccagcagacgaccnggccaggcctccaggtcctcctcattcgtttcggcgccgtcccaccgacgggccctacgtggaccactccccgagaccgtacggtttcaagggttcggacgtagggttcggggttccgtacggggtaaccaacggttccttttaacccgacctttcccgtaccctaaacccgtaacgttaccgaaccggtacctaacggttaaccgtttacggtaaccgggttaccccgtttaagggtaaacgtttaacgtttttacggaacccgttaaaggtttaaacttttaacgtttacccgttaggttaccgtaacgttaccaagtttaaccgttaacgggaacggtaccgtacggtaacgttgggttaccggggtccggttaccggaaccgggaaacgggtaacccggtaaggttaacgggaaaccttaaaccggaaaacggttaaccggttcggttacgggtaccgttacgacccgtaaccgttacttccgttcgtttaacccg

SEQ ID NO: 103467 - DNA, 665 bp, Homo sapiens
  misc_feature: GYAE6OF01DMZJJ.34.34.D01.1.454.CMB.1.raw
  modified_base (158)..(158): a, c, t, g, unknown or other
  misc_feature (158)..(158): n is a, c, g, or t
  modified_base (206)..(206): a, c, t, g, unknown or other
  misc_feature (206)..(206): n is a, c, g, or t
  modified_base (524)..(524): a, c, t, g, unknown or other
  misc_feature (524)..(524): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccatggaagaaatagtnatgacgcagtctccagcccacctgtctgtgtcgtccgaaggggaaacncgcccaccctctcctggcacggccagtacagtagttcggttcgacgagactaaacgttcgccgtacggtacgaacgaccaaacggtaaaccgtcggaccgaacgccgtacccagtacgtcctacattcgtaatcgacctacacctccaccggacggcctacgtcgtacttaccttcgacgtccgtaggttacaggtcggacgtacggttcggtcggtacggactaggtacttccgaacttccgtaccaacgtactacgacgtacacggtcctggactagtactagactcgtttctcgtacttactttagtactagtanacgtctaacgtagttaagtacgttccggtacggtacgggtaccgttaccgggaacggaaacgggtaaccgtaaggtaaacggtaaacgtaaccaaacggtaaggtcggtaacggtccacggtacctacgtgttacgttacg

SEQ ID NO: 103468 - DNA, 675 bp, Homo sapiens
  misc_feature: GYAE6OF01AN401.34.34.D01.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (322)..(322): a, c, t, g, unknown or other
  misc_feature (322)..(322): n is a, c, g, or t
  modified_base (519)..(519): a, c, t, g, unknown or other
  misc_feature (519)..(519): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactgganaaatagtgatgacgcagtctccagcccaccctgtctgtgtctccgaggggaaancgcccaccctctcctggcacgggccagtcagtgttgttggcagtcctaacgttgcctggtaccagcacgaacctggccacggcctcccagtacgtcctacacttcctatcgcctacnctacccaccgacgggcctacgcgtaccttacgtccaacgtccctaggttcaggttcggacgtagggtcgggtcgtagggactacggtagttaccgactcctaccgacctaagtccgaacgcgaacggtccctaggactacgttaccgtaagaacgtactttcgtacgttaccttactttttaactttccgtacgttnaacggtctaacgttacctaaaggttacggtcggtacccggtaggtacccgggttacggaccgtaaacgggtaaccggtaaagggtacgaaaccttacggtaaaccggtacgtttgggtacgggtaccttcggaaccctaaccgtcgttcgttaccg

SEQ ID NO: 103469 - DNA, 374 bp, Homo sapiens
  misc_feature: GYAE6OF01DC217.34.34.D01.1.454.CMB.1.raw
  modified_base (152)..(152): a, c, t, g, unknown or other
  misc_feature (152)..(152): n is a, c, g, or t
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (328)..(374): a, c, t, g, unknown or other
  misc_feature (328)..(374): n is a, c, g, or t
tcagtacacgtgatcacgaccggtgctcgatttagatcgtctgtgttggggtttgggggagaactgctcagttaggacccagacggaaccatggaagccccagcgcagcttctcttcctcctgctactctggcctccagacaccatgggaanaaaatgtgatggacgcagtccnccagtccacctgtctgtcgtcacggaaggggaaacncgccctacctgtccnggacgaacgggtccaagtcgagtaggtgtcggacaaggtctaaacggttcacgttcgggaaaccancggtaaacgtaaacgcgacgcggaccnccgaaggtcnnnnnnnnnnnnnnnnnnnnnnnnnnnnnnnnnnnnnnnnnnnnnnn

SEQ ID NO: 103470 - DNA, 770 bp, Homo sapiens
  misc_feature: GYAE6OF01BTK2T.34.34.D01.1.454.CMB.1.raw
tcagtacacgtgatcacgaccggtgctcgatttagatcgtctgtgttgggtttgggggaggaactgcccagttaggacccagacggaaccatggaagccccacgcgcagcttctcttcctcctgctactctggctcccagacaccactggagaaatagtgatgacgcagtctccagccaccctgtctgtgtctccgaggggaaagacgccacctctccgtgacgagggccagtcaggtagtggttggcagctaacgttagccgtggtaccaggaccaagaaccgtggccaggtcctacccgagacgtccctctatctagtcgtcctaacgtctaccccgaccgaacgggtcccaagttcgtaccgtttacttaccgacgtacccgttaggttaccgaggtcggactagggttggggttacccgagggaaccgtaaggttacccgtttaccgaccttaccgtaacccaaccccgttaagtaccgaacggtcccgtaccgggtcccttacgggtaccgtacggttacgtaacggaaacgttaccgtttacgttcgtaaaccttttaacgttttaactttaacggttccgttaccgtacgtaaccgttaacgttaacgttaaagttacggttaccggttacccgggttagggtacccggtttacgggaacccgtaagggaacccgtaaagggtaaggtaaaccgtaacgtaaacccggtaggttaccgtacgggtacttacggtaccctaacgtccgttcgttaccgttcccg

SEQ ID NO: 103471 - DNA, 652 bp, Homo sapiens
  misc_feature: GYAE6OF01ECSWW.34.34.D01.1.454.CMB.1.raw
  modified_base (205)..(205): a, c, t, g, unknown or other
  misc_feature (205)..(205): n is a, c, g, or t
  modified_base (327)..(327): a, c, t, g, unknown or other
  misc_feature (327)..(327): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaaggggaaancgcccaccctctccgtgcagggccagtcagagtgttggcagactaacttgccgtcggtaccagacaacgaaaccgtcggccgacggcctacccgacggacgtcctctactctatcacctacnctaccgaccgacggacactcacttcaagttcccaaggttcccaaggttcgacgtaggtcggacttgggggacctaggggaacgttacgaacgtttcctactacctactacccaagtccaaggcctaggccctaggtacctaggtacgtagtaacgtattcctacgtttactactttaacgttactagtctaagtcttaagttacgtaagttaacggttgggaccggttagggtaccgttaacgggaccgaaagggtaccggtaaaggtacggaaaacgtaaccgtaacggtaacgtcggtacggactaacgactaccgtagttcg

SEQ ID NO: 103472 - DNA, 696 bp, Homo sapiens
  misc_feature: GYAE6OF01CV8IP.34.34.D01.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggagaaatagtgactgacgcagtcctccagccaccctgtctgtgtctcgaaggggaanacgccaccctctccngcagggccagtcagagtgtgcagcaacttgctggtaccagcaagaactggaccaggctccagngtccnactctatgactacatccaccnggccaacgtcgacttacgtccctacgacctacggttacacggtcggcgtaggtgggtaccgtggggaaccgtaggttacgttaccacgttaccctacaaccctgtaccaacgccgaacgtcccttgaccggtaacgttacctaggtaacggtaactttccgtacggttacctttaactttttacttaacgttacgttacgtacgtaaccgttaaggttacctttaaaaaggtccggtttaacgggtacccggttacggggtaccggttacgggtaccccgggaaacgggtaaaccgggaaacgggtaaggtaaaaccgtaaccgtaaaacggtacgtaacggttacggtacgtacggtaaccccaacgttccgtacgtttaacccgg

SEQ ID NO: 103473 - DNA, 752 bp, Homo sapiens
  misc_feature: GYAE6OF01D38FM.34.34.D01.1.454.CMB.1.raw
  modified_base (206)..(206): a, c, t, g, unknown or other
  misc_feature (206)..(206): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccacgccaccctgtctgtgtcctccgaggggaacncgcccaccctctcctgcgagggccagtcagagtgtgcagctaacttgcctggtaccagcgaacgaaaccgtggaccaggcctacccagacgtcctacgtatctagttgacctaacaccgtacccaaccgacgggaccctacgtcgaccttagttccccgaggtacccgtaggtttccgaggtacgggacgtacgggtttggggtaaccgttaggggaacctagggtaccgtttccggaccttaccgttaccaaccctagtaccaacgggtacctacggtcccgttagaccgtaggtaccgttaggtaaccttactttcgtacggttacctttaacgtttttacttaccgtaggtacctacgtaaccgtaagtttaaccgttaaaaggttaacgggttccgggtaccggtttaggggtaacccggtttcccgggaaaccggtaaaacggggtaaccgtaaaggggttacgaaaaccgtacccgtaaaacgggtaccgttagggtacgtaacccgttcggaaccctaacccgttagtccgtttaccgg

SEQ ID NO: 103474 - DNA, 751 bp, Homo sapiens
  misc_feature: GYAE6OF01BC3NL.34.34.D01.1.454.CMB.1.raw
  modified_base (209)..(209): a, c, t, g, unknown or other
  misc_feature (209)..(209): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagaccaccactggaagaaatgtgactgacgcagtctccagcccacctgtctgtcgtctaccgaggggaaancgccaccctctcctgcacgggccagtcaggagttgtggcagcaacgttgcctaggtaccagacaacgaaaccgtcggaccacggcctacccgagtaccgtcctctaactctagtcgtactaccactacccaccgacgggccaacgtcgaccttacttccgacgtaccgtaggtactacgggtaggccgtagggttcggtacggtacgggaacgtaggttacgtttaccgaacccgttcgtacccgtaacctacgttacgaacgccgtaaccgtcctacggtacgtacgttcgtaacggtaacgttaccggtttactacggtaccttttaacctttaatttacggttacgttaccgtaacgtaacgttaccgttaacgttaacggtttaaacggtcggtacccgggttagggtacccggtttaccgggaaccggtaaaccggggtaaccggtaaacgggtaaacgttaaaccgtaacggtaaaaccggtacgtcgggtaacggtaccgttacggtaaccgtaccgtacgtttcccgtttaccg

SEQ ID NO: 103475 - DNA, 842 bp, Homo sapiens
  misc_feature: GYAE6OF01BSCAJ.34.34.D01.1.454.CMB.1.raw
  modified_base (203)..(203): a, c, t, g, unknown or other
  misc_feature (203)..(203): n is a, c, g, or t
  modified_base (807)..(807): a, c, t, g, unknown or other
  misc_feature (807)..(807): n is a, c, g, or t
  modified_base (811)..(811): a, c, t, g, unknown or other
  misc_feature (811)..(811): n is a, c, g, or t
  modified_base (815)..(815): a, c, t, g, unknown or other
  misc_feature (815)..(815): n is a, c, g, or t
  modified_base (820)..(820): a, c, t, g, unknown or other
  misc_feature (820)..(820): n is a, c, g, or t
  modified_base (823)..(823): a, c, t, g, unknown or other
  misc_feature (823)..(823): n is a, c, g, or t
  modified_base (826)..(826): a, c, t, g, unknown or other
  misc_feature (826)..(826): n is a, c, g, or t
  modified_base (830)..(830): a, c, t, g, unknown or other
  misc_feature (830)..(830): n is a, c, g, or t
  modified_base (832)..(833): a, c, t, g, unknown or other
  misc_feature (832)..(833): n is a, c, g, or t
  modified_base (835)..(835): a, c, t, g, unknown or other
  misc_feature (835)..(835): n is a, c, g, or t
  modified_base (837)..(837): a, c, t, g, unknown or other
  misc_feature (837)..(837): n is a, c, g, or t
  modified_base (839)..(839): a, c, t, g, unknown or other
  misc_feature (839)..(839): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccacctgtctgtcgtcgcgaggggaancgcccaccctctcctgcgacgggccagtcaggagtggttcggacagactaacgttacgccgtaggtacccaggacgaacgaaaccgtcggaccgaggtcctacccgagtacgtccctcaatccgtatacgacctacacgtaccgaccgacgggccctacgtcgccttaacttccgaccgtccggtaaggttccgagggtcggtaccgtagggtttcggggtacgttaggggaccgtaacggtaccgtttaaccgtacccgttaccgtaccccgaaccgttacggttaacccgtaacggtaccccggttacgggtaccccgttaaacgggttaccgttaaacccggggtttaacggtttaaacgggtttaaaccgggttttaacccgttttttaccccgggtaaaccgttttacccccggttttttaaaacctttttttaacccggtttttaaacccgggtttaacgtttttaacccccggggtaaaccggggttttaaaccccgggtttttttaaaaccccccggggggttttttaaaaaaaaccccggggttttttttaaaaaacccgggggggtttttttaaaaaccccgggggggggggcngcgntganacganagngangacngnncngncntgc

SEQ ID NO: 103476 - DNA, 730 bp, Homo sapiens
  misc_feature: GYAE6OF01A3SLW.34.34.D01.1.454.CMB.1.raw
  modified_base (161)..(161): a, c, t, g, unknown or other
  misc_feature (161)..(161): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
tcagtacacgtgatcacgaccggtgctcgatttagatcgtctgtgttgggtttgggggaggaacgtgctcagttaggacccagacggaaccatggaagccccagcgcagcttctcttcctcctgctactctggcctccagacaccactggaagaaatagtnatgacgcagtcctcagccacctgtctgtcgtacnccgaaggggaaacncgcctaccctctccgtgcgagggccagtcaggtagttggttcggacagacctaaactttcggccgttacggtaaccaacggacgtaaacggaaacccgttgggaccccgaggtacccgtaccccaagggtaccttcccctctaaacgttcctagttcacccttacacgtacccggaccggaacggccctagtacgtacccttacgttcccacgtaccgttaacggttgaacgggtcgtaccggaaggtttccgggtaacgtagggaacaggttacttacgacctcgtacccaacgtacaccgtacgtaccgagtccccgtaggactaccgttcggtaacgtaacgttcgtttaccgacggttacctttaactttacgtactcggtacacgtaccgttataacgttaagtacggtcggtacccgtagggttcccgtacggaaccggtaacgggttaacgaaaggttacggaaataacggtacgtaccgtggacgttcacgacccgttactgttccggttacg

SEQ ID NO: 103477 - DNA, 661 bp, Homo sapiens
  misc_feature: GYAE6OF01EJGJ8.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagaccaccactggagaaatagtgatgacgcagtctccagcccacctgtctgtgtctccgaggggaaancgcccaccctctcctgcagggccagtcagagtgtggcagctaacttgcctaggtaccagcaacgaaccgtggaccaggcctccgagacgtcctacgatctagtcgacctacactacccgaccgacgggccctacgtcgtaccttacttcccgacggtacccgtaggttaccagggttcggacgtagggttcgggtccgtagggactacggtacgttccgaccttccgaccaaccgtatccgagtccacgtccgtgacgtaacgtcgtagtaacgtctttacgtacgtacctttacgttttacttaccgtgtacctagtacctaagtactaaagttacggtcgggtaccgttagggtaccgttacgggaaccgaaaggggtaaccgtaaaggggtaacgaaagtacccggtaaaacggtacgtcggtacggtacctacgacctaacctgttcgtacg

SEQ ID NO: 103478 - DNA, 716 bp, Homo sapiens
  misc_feature: GYAE6OF01CKA03.34.34.D01.1.454.CMB.1.raw
  modified_base (206)..(206): a, c, t, g, unknown or other
  misc_feature (206)..(206): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtcgtctccgaggggaaancgccaccctctcctgcgagggccagtcagagtgtggcagctaacgttagccgtaggtaaccagacaacgaaaaccgtggacccaggccctaccgacggtacgtcctactacttacctaatcgaccttaacacttacccgaaccgacgggccctacgtcgtaccttacttcccgaacggtccgtaggtttcgaaggtcggactaggggtcgggtacgtacgggaacgtaggtaacgtttcaccttcgtaccaacgtacctacgacgtccgacgtcccgtgtaccgtagttccgtagtaacgtactttcacggttaccttaactttttacgttactcgttacgtaacgtacttaacgttaacgtaaaggttacggtccggggttacgtacgggttacggttaccgggaaccggtaaacgggaaccgttaaagggtaaccggaaacttaaaccggaaaggtttaccggaggtcggtaaccctacggtaccccaacgttcgtttccgttaccgg

SEQ ID NO: 103479 - DNA, 710 bp, Homo sapiens
  misc_feature: GYAE6OF01BCKJ9.34.34.D01.1.454.CMB.1.raw
  modified_base (562)..(562): a, c, t, g, unknown or other
  misc_feature (562)..(562): n is a, c, g, or t
tcagtacacgtgatcacgaccggtgctcgatttagatcgtctgtgttgggtttgggggaggaactgctcagttaggacccagacggaacatggagcccagcgcagcttctcttcctcctgctactctggcctccagacaccactggagaaatagtgatgacgcagtcctccagcccaccctgtctagtgtcctaccgaaggggaagaccgccctaccctctcctggcaggggtacccagtcgaagtaggtgttacgggacagccgaacttacgccgtagtacccagaccgacgaaacgtcggaccacggtcctaccgacgtacgtcctacattactagtcgtacctacacctaccgaacccgtaggccctagtcgactactccaggtacccgtaaggttccgaaggtggtctacggggttcgggttacaggggaacctagttccggtacaccgtcttaccaaccgtcgtacgacgacgtccgacccgttgaaccgtgttaccgtaaggaacctgttttcgacctcgtttaaactttggtaacttggtaccgacgttaaccgntttaaaccgttaaaggtacggtccggggttaaccggtggtaaccgggttacccggagaaaccggggtactaaacggggtagtaacctaaccgggtaaagtacccggttaggtacgtcccgttaagccccttaactcggttacttacgg

SEQ ID NO: 103480 - DNA, 734 bp, Homo sapiens
  misc_feature: GYAE6OF01BH62T.34.34.D01.1.454.CMB.1.raw
tcagtacacgtgatcacgaccggtgctcgatttagatcgtctgtgttggggtttgggggaggaactgctcagttaggacccagacggaaccatggaagccccagcgcagcttctcttcctcctgctactctggcctcccagacaccactggagaaatagtgatgacgcagtctccacgccaccctgtctgtcgtctccgaaggggaaacgcgcccaccctctcctgcgacgggccagtcaggtagtggttggcacgtactaacgttacgccgttaggtaccagacgaacggaaacctcggacctacggcctaccgaggtacgtcctcatctatcgacctacactccgaccgacggcctactcgtcttacgtaccgacgtaccgtaggtcgagggtcgtacgtagggttcgggtcgtagggaactaggtacgttacaccttctacctactacgtcgacgacgtcgtacctgacgtacgtacgtagaacgttcgttacttacgtacgtttacttttaacgtcgttacgacgtaacgtaccgttaagttaacccgttaaaggttacgggttacgggtaacccgggttaggggttaaccccggtacgggtaacccggggtaaaaccggggtaaacccgggttaaagggtaaacgtaaaacccgttaaacgggaaaaacccgtggttaaccggggacggttaccctacggtaaccctacggttaccgttcgtttacccg

SEQ ID NO: 103481 - DNA, 684 bp, Homo sapiens
  misc_feature: GYAE6OF01CCOFG.34.34.D01.1.454.CMB.1.raw
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccacgtggaagaaatgtgaatgacgcagtcctccacgcccacccgtgtctgtcgtcgtaccgaggggaacncgcccaccctctccngcgacggccagtcagtagtgttggacagacatacgccgtacgtaccagcgaacgtaaccgtggacccgacggtcctaccgagtaccgtcctactaactacctatacgtacctacctaacctacccgaacccggacgggtacccacttacggtaacctaccgttacccgaacggttaccgtacggttaccgaggttcgggaccgtaggggttcggtacgagggtacaggtactcgtacctactaccacctagtacgagccacgctagacgtatacgtaggacttgttacctagtccttaattttactacgtatcgaggtactacgttaacgttaacgaggttccgttaacgtacgggtacccgtacggaaaccgtaacgggtaccggtaaaggtacggtaaagtacccgaaaggttacggcgttaacggctacgaaccttctaagttccgttaccg

SEQ ID NO: 103482 - DNA, 713 bp, Homo sapiens
  misc_feature: GYAE6OF01AE2SH.34.34.D01.1.454.CMB.1.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaacncgcccaccctctccgtgcgacgggccagtcaggagttgttggcagtcctaaacttcgcctggtaaccngaccgaacgaaaccgtcggaccgacggcccttaccacggtacgtccctctatcctatcgactaccnctacccaccgacgggccacgtcgtactacttccgacggtccgtacggtttcacggttcggcgtagggttcgggtccgtggggaactaggttacgttacacctccgtaccaaccgtactaccaacggcctacggtcccgtcgacgttaccggttacgtaacgtaacgttctttaccgtacgttactttaacgtttttccttacgtccggttactacggtacttacgttaaccgttaaggttacggtcgggtaccggttacggtaccggttaccgggtaacggtaaaccgggtacggtaaacgggttacgaaacgttaccggtaaacggtacgttcggttaccggtcgtaccgtaaccgtcctagttcgttacccg

SEQ ID NO: 103483 - DNA, 670 bp, Homo sapiens
  misc_feature: GYAE6OF01BAP49.34.34.D01.1.454.CMB.1.raw
  modified_base (209)..(209): a, c, t, g, unknown or other
  misc_feature (209)..(209): n is a, c, g, or t
tcagtacacgtgatcacgaccggtgctcgatttagatcgtctgtggttgggtttgggggagaactgctcagttaggacccagacggaaccatggaagccccagcgcagcttctcttcctcctgctactctggcctcccagacaccacgtggaagaaatagtgacgtgacgcagtctccagcccacctgtctgtcgtctcgagggaagcnccacctctctcgcagggccagtcagcgtgtgcagcaatgctgacagcacgaaccgtgaccaggcctccgagtacgtcctaccgatacctagtcacctacgtactcccaacgacggtccacgtcgtaccttacgtccgtacgcccgtaggtccacgggtgccgtagggttcgggtacgtgggaactacggtacgttaccacgttctccgaacctcgtcgtaacgaccgtccggtctacggtcgtagtccgtaaggacttacgttacgtcttactttacgtttaattcgtactacgtcgtacgttacgtaacgttaaggttcggtacggtcccggtacgggtaccggttaccggaaccgggtaaccgggtaaccgtaagggtaccggaaaaacgtttccggaaaacggttacggttaacgggtcgtaacggtccccgtaagtacccggtgttccggttaaccg

SEQ ID NO: 103484 - DNA, 705 bp, Homo sapiens
  misc_feature: GYAE6OF01EKE5I.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtcgtctccgaaggggaaacgacgcccaccctctcctgcgacgggccagtcagaggtgttggcagctaacttgccgtggtacccagacaacgaacctggacccaggcctaccgagacgtcctacactctagtcgctaacactcccgaccgacgggcctacgtcgaccttactccgacgccgtaacggttccaggtcggacgtaggttcgggtacgtagggaactagggtaacgttccaccttcctaccgacctacgtaccgacgctaacggcctacggccgtacgttacgtaagtaacgttacttccgtagtacccgtttacgttttaactttccttacgtaccaggtaacctaacgttaacgttaaacggtaaggttcgggtcccggttaagggttacccgttaccgggaaccgggaaaacgggtaacccggtaaagggtacgtaaaaaccgtaccggtaaaacggtcgttaacggccgggttacgtaacggaaccgttacccgtagttcccggttacg

SEQ ID NO: 103485 - DNA, 614 bp, Homo sapiens
  misc_feature: GYAE6OF01EXEO0.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangcccaccctctcctgcagggccagtcaggagtgttggcagcaacttgcctggtaccagcagaaacctggccaggcctcccagagtccctcatctatcgctacactcccaaccgagggccacttgcttatccagcctaggtccaggtcggcaggtgggtctgggacagacgttcactctacacctatcagcgacgcctgactagtctagaacgtatttcctgtaccttacgttttaattacccttagtaccgacgtacgtaagttacgttaaagttaacgggtcggtacccggttagggtacccggttcgggacccgtaaaggggacccgtaaaggggttacgaaaagttcccgaaaaacggtacgttagggtaccggtacttacggaccctaacgtacgttcgttaccgg

SEQ ID NO: 103486 - DNA, 979 bp, Homo sapiens
  misc_feature: GYAE6OF01BO1NQ.34.34.D01.1.454.CMB.1.raw
tcagtacacgtgatcacgaccggtgctcgatttagatcgtctgtgttggggtttgggggaggaactgctcagttaggacccagacggaaccatggaacgccccagcgcagcttctcttcctcctgctactctggcctcccagacaccacgtaggagaaatagtgagtacggacgcagtcctaccacgccctacccgtcgttctcggtcgtccgtaccggaaagggggaaacgaccggtccccacccttccgtccgtacggaccggacggggtaccaacggtcgaagggttggttacggttacgggaccgaacggtaaccttaaccgtttacggtacccggttacggtaaccgaacggaaccggaaaccggtaaacccgtcgggacccgaacgggtccctaaccccggtaaggttacccgtaccttaccgtaccttacgttacgttaccgtaccttaacctaacccgtacccgaccggaaccgggtaccctaacccgttcgtaaccctttaccggtacccgaccggtaccggttacggttacgtcgggcggtaccggtagggttacggggttaccgtacgggtaacggtacggtaccgtttccgtaaccggtacctaccgtaacccgttaacaccgggttacgaacccggtaccgtaccgttacggtaccgttaacgtaaccgttaaggttaaacccgggtcttttaacgtaccggtacttttttaaacgttttcggttactaaccggttaccgaagttaccgtttaaccgtaaacgttttaaacgggtaacccgggttccggggtaaccggtttaccggggtaaccgggtaacccgggttaaaccggggtaaaacgggtaaaccccgggtttaaagggaaaacccgggttaaaactaaacccgggggtaacgttaaacccgggttacgggtacggttaaacccggcgtaaacccctaacgttccggtttacctaaccgg

SEQ ID NO: 103487 - DNA, 612 bp, Homo sapiens
  misc_feature: GYAE6OF01EBDAP.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccaccggagaaattgtgttgacacagtctccagccaccctgtctttgtctcgaggggaaancgccacctctcctgcgagggccagtcagtagtgttagcggctactagcctggaccagcaagaacctggccaggcctcccgaggtcctcctcatctatgatcggccgtccgaacgcgggacccacgtcggacacgtcccgagcccgtagggttcaggttggcgtagggtcgggtcgtacgggacctagtacctttcacgttcctaccaccactaccgacgacgacgtacctaacgacgtaccgttaaagttactttacgaactttaattttactacgttgtacacgtcgtacgacgtacacgtacgtccggtacccttccgtagacgtccgtccgttcgggaccggacggtacacgtacgtaggagtaacgtaacgtagtcgacgcgtacacctactatcgtctctaccg

SEQ ID NO: 103488 - DNA, 763 bp, Homo sapiens
  misc_feature: GYAE6OF01DSYFC.34.34.D01.1.454.CMB.1.raw
  modified_base (174)..(174): a, c, t, g, unknown or other
  misc_feature (174)..(174): n is a, c, g, or t
  modified_base (215)..(215): a, c, t, g, unknown or other
  misc_feature (215)..(215): n is a, c, g, or t
  modified_base (468)..(468): a, c, t, g, unknown or other
  misc_feature (468)..(468): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggaagaaatagtgatgacgcagtccnccacgcccaccctgtctgtcgtcgtaccggaaggggaaacncgcccaccctctccgtggaccgacgggccagtcaggtagtgttgacagactaactcgcgtacgtaccagaccgaacgaaccgtcggaccgacggtcctacccgagtaccgtcctactattcctagtctacctacacctacccgaacggacggtacccagtcgtacctactccgacgtacgtacggttacgcgggtcgacgtggggttcgggtacgtaggactaggttaccgtctacctccgtaactaccgtanaccgaacgtccgtacggtaccctggaacgttacggttaactaagggtaacgtttccttaccgggttacttaacctttttaacgtttacgtacccgtagtacccggtaattaacccgggttaagtttaaacgttaacgggttacccggggtccgggttaccgggtacggggttaacccgggttaaacccggaacggggtaaaagggtaccggtaaaagggtaacgtaaaccctaagggtaaacccgtggttcgggttaacggcttaaccggtacacggtttacgttcccttaacgg

SEQ ID NO: 103489 - DNA, 732 bp, Homo sapiens
  misc_feature: GYAE6OF01AUKPK.34.34.D01.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (528)..(528): a, c, t, g, unknown or other
  misc_feature (528)..(528): n is a, c, g, or t
tcagtacacgtgatcacgaccggtgctcgatttagatcgtctgtggttggggttgggggaggaacgtgctcagttaggacccaggacggaaccagtggaacgccccagcgcagtcttctcttccgtcctagcctactcgtggacctcccgagaccacctagtggaanaaactgtgatcggaacgcacgtcctcccaggcccnccgttgtcctggtacctcgaccgaaggggaactccgccctaccctgtccgaggaccgacgggacctagtaccgaggtacgttcggtacgacgaacgtaccttaacgttcgccgtacggtaaccacgaacgtaaccgaacgtcggccaacgggtcctacccgaggtacccgtcctgaacttcacgttcaccggaactccaacccggtcggtaacggcctacgtcgacctttacgaccgacccgtagggttacccggtntacgggnacgggtacggtcgggtgtacggaacttacggtctttccaaacttcgacccaatctacggacncgtcctcgtacgacgtaactacgttacgaacttcgttcggaacttcttactttaactcgacttgacggttactaacgtaacgtagttaacgtccgggttagaccggtaccggtagaacggaccgtaaaaggttcgggaactaaacgtacggtaaacgtacgggttagcggttaaaccagtaccccgttaaatccggtacttacg

SEQ ID NO: 103490 - DNA, 840 bp, Homo sapiens
  misc_feature: GYAE6OF01EXV18.34.34.D01.1.454.CMB.1.raw
tcagtacacgtgatcacgaccggtgctcgatttagatcgtctgtgttgggttgggggaggaactgctcagttaggacccagacggaaccatggaacgccccagcgcagcttctcttcctcctgctactctgcctccagacaccacgtggaagaaatagtgaatcgacgctacgtcctaccacgtccctaccgttgtctggtcgtccgtacggaaggggaaacgtccgaccctaccctccgtccgtgacgtaaccgggctaggcgtaaggtacggttgtcggacacgtactacgttacgcgtcgtaccgacgtacaacgtaaccgtcggaccgaacggtccgtacccgaggtaccgtacctacgtacgtacttacgacgtactaccaccgtacccaccggaaccgggcctacgtaccgtaccttaacgtcccgactaccggtagttaccgtagggtcgacggttggtacgggtacgtagggtactacgtacgtacctacgttcctaaccgtactagttaccgacgtacgcgtacctacgtaccgtaagttacgtaacgtaacgttctttaacgtacgtttacgtttaacctttacgtttaacgtaccgttacgtaacgttaccggttaaccgttaaacgggtttaacggttaaccggggttacgtttaacccggggtcgggttaaacccgggttacccggggtaaaaccgggtaaaaccgggtaaaccggttaaaccggggttaaaacggaaacgttaaccggtaaaacccgggtacggttaacgggtaacgtacccggtaacgtaacccgttacccggtaaagttcccggtttaaccccg

SEQ ID NO: 103491 - DNA, 770 bp, Homo sapiens
  misc_feature: GYAE6OF01EFKAQ.34.34.D01.1.454.CMB.1.raw
  modified_base (156)..(156): a, c, t, g, unknown or other
  misc_feature (156)..(156): n is a, c, g, or t
  modified_base (229)..(229): a, c, t, g, unknown or other
  misc_feature (229)..(229): n is a, c, g, or t
  modified_base (498)..(498): a, c, t, g, unknown or other
  misc_feature (498)..(498): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagaccaccacgtggaanaaatagtgatacggacgctacgtcctccgacgcccctacccgttgtctggtcgtccgtaccggaaggggaacnccgccctaccccttctccgtggaccgacgggacctagtacgaggtagttcggtcgacacgtactaacgttcgccgtacggtaccaggaccaaccggtaacccgtcggacccgtacggtcccctaccgaggttacccgtcctacgtacttacgtactcgtacctacgacccgaccgaccggacggcctacgtcgtaccttacgtccgacgtaccgtaggtacagggtcgacggtagggttcggtacggacggtacgtaaggttccttacncccgttactacccgtaacgtcgtaccgacgtaccgtaccgccgttagtaccgtacgttacgaacgttacgtttccgttcgttaccgttactttaactttaccgttaacgttcgactacgtacgttattaaccgtaaaggttcgggtacggtccggttacgggtaccggtaccggaaccgggtaacggaacggttaacgggtaaactaaaccggtaggtaaaccggttcggtacgggacgttacgaccgtaacctacgttccgttgttacccg

SEQ ID NO: 103492 - DNA, 181 bp, Homo sapiens
  misc_feature: GYAE6OF01C35JA.34.34.D01.1.454.CMB.1.raw
  modified_base (174)..(181): a, c, t, g, unknown or other
  misc_feature (174)..(181): n is a, c, g, or t
tcagtacacgtgatcacgaccggtgctcgatttagatcgtctgtgttgggtttgggggaagaggaagactgacggtccccccaggagttcaggtgctgggcacagcggccctgggctgcctggtcaaggactacttccatcacgtgtactgagcgggctggcaaggcgcatagnnnnnnnn

SEQ ID NO: 103493 - DNA, 735 bp, Homo sapiens
  misc_feature: GYAE6OF01CDQWU.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggaagaaatagtgatgacgcagtctcagccacctgtctgtgtctacgaaggggaaagacgccacctctcctgccgagggtccagtcaggtagtgttggacagtacaacttagcctacggtaccagaccaagaaacctggaccaggcctaccgagtacgtcctacattcgtatcgacctaacactaccaacgacgggaccacgtcgtactactaccacgcctaggttcgaaggtcggacgtagggttcgggtacgtagggaacagtacgtttacctactcctaacacctaatcgaacgcgaacgccgtagactaacggtacgtaagaaagttctttacgacgtactttaacgttttacttacgtacgtacaacgtacgtaaagtttacgttaaaagtacgggttccgggtaacccggttacgggttaaacccgggttacccgggtaaaaccgggaaacggggtaaaaaccgggtaaacggggttaaacggtaaaaaaccgttaaaccggtaaaaaacgggttaacccgttaaggggtccgggtaaccttaacgaacccggtaaacccgtttaagtccccgttttaaacg

SEQ ID NO: 103494 - DNA, 808 bp, Homo sapiens
  misc_feature: GYAE6OF01A0N6F.34.34.D01.1.454.CMB.1.raw
  modified_base (150)..(150): a, c, t, g, unknown or other
  misc_feature (150)..(150): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagtacacgtgatcacgaccggtgctcgatttagatcgtctgtgttgggtttggggaggaactgctcagttaggacccagacggaaccatggaagccccagcgcagcttctcttcctcctgctactctgactcccagacaccactgganaatcgtgatgacgcagtctccagccacctgtctgtgtctccgaggggaancgccacctctcctgcagggtcagtcagngtgttgcagcaacttgcctggtaccagcacgaaccgtggccaggtcctaccgaggtacgtcctcgagttcctagtcgaccttacgacttacccgaccgagggtccctacgtgtacctacgttcccgaagtcccgaaggttccgaaggtcggactaggttcgggtctacggggactaggtacgtttcgaacttacgtaccaactacgtaccgacggtaccgtacgtacccgtacggtacctaacggtttacgtaacggtaaccgtaacgttttcccgtaacggtaacccgtttaacgtttttaaccgttaccggttaccgttaccggtaacggtttaccgtaaaccggtttaaccgttaaaaggtttaaccgggtttccggggtaacccgggtttacggggtaacccggtttacccggggtaaacccggttaaaccgggggtaacccgttaaaaccggggtaaccgggttaaaacccgttaaccccggtaaaaaccgggttaaacccgttcggggttaccccgggtaccgtttaccgggaaacccccggttaacccgttggtttaccccggtttaacccgg

SEQ ID NO: 103495 - DNA, 693 bp, Homo sapiens
  misc_feature: GYAE6OF01DH47G.34.34.D01.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangcccacctctccngcagggccagtcagagtgttggcagctaacttcgcctaggtaccagcaagaaaccgtggccaaggtcctcccgaagtacgtcccgtcacgtctagtcgtactacactacccacgacgggcctacgtcgccttaacttccgagacctaggttcacggtggccgtaggtcggtacgtgggacgtagtacgttacaacttccgtacacctaatccgacgacacgtacccgtagtcgtaagttactagtaacgtcttacgtcgtaacttacgtttttacttaccgtgttacaagttacgtaacggtttaactaagttacggttacgggtacccgttggggtaacccggtttcggaaaccgggtaaccggtaaaccggtaagggtaaacggtaaacgttaacccggtaaaaaccggtaaccgttagggtaaccgggtaccttaacggaccctttaaaccggtcgtttccggtttaacccgg

SEQ ID NO: 103496 - DNA, 784 bp, Homo sapiens
  misc_feature: GYAE6OF01D2EDF.34.34.D01.1.454.CMB.1.raw
  modified_base (161)..(161): a, c, t, g, unknown or other
  misc_feature (161)..(161): n is a, c, g, or t
  modified_base (173)..(173): a, c, t, g, unknown or other
  misc_feature (173)..(173): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctccagacaccactggaagaaatagtnatgacgcagtcnccagccaccctgtctgtcgtctacggaaggggaacacgccctacccgtctccgtggacgacgggaccctagtacgaggtaggttggttcggacgaacgtactaaacgttccggtaccgttacggtaaccacgaccgtaaaccggaaccggtcgggacccaacgggtccctaccgtaaggtccttcctactaacttctacgtcgtacctaacgacctacccgaacggtcggaccctacgttctaccgttacctcccgacgtaccggttacggttacgacggttaggacggagggtttcgggtacgtaacgggacgtaacggttctttaaccgtccttacctaccgacctagtaccgacgccgtaacgtccgtaggtacctaggttacagggtaactctttaccgtacgtttaactttacttttacgtacttcgaactacgtacgttagttaacgttaacggttaacgggttccgggtacggttaccggggtaaccgtacccgggtaaacggaacgggtaaccgtaaagggtaaacggtaaacttaaccggaaagggttaccgttggaacccggttacgtacccgtaaacgtccgttagtttccggttacccg

SEQ ID NO: 103497 - DNA, 695 bp, Homo sapiens
  misc_feature: GYAE6OF01BWMZN.34.34.D01.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccgtgtctgtgtctccgaggggaaanaatcaccctctcctgcagggccagccagagtgttagcagcaacgttggcctggtaccagcaaggaacctggccaggcctcccgaggcctcctctatctagtcggtncctaactcccaccgagggccctactcggtactcccgagccgtaggttcaggtggcnggtgggtcgtgggacagtatccatccacaccatcgatccacgtccgtcgacgtacgtcgtaagtaaggtttactttaggtacctttagttttacctttaacgtcgttacgacgtactaaggtttaacttaaaggttaacccgggttccgggtcccggttacccggggggtaccgttacccggggaaacccggtaaggggtaaccccggttaaaggggttaccgggtaaaaccgtttaaccggtaaaacccggtaacggggttcgttacccgggaccggttacgtaaccccggtacttacggttacccgtttaggttcccgttttaacccg

SEQ ID NO: 103498 - DNA, 630 bp, Homo sapiens
  misc_feature: GYAE6OF01DOFR4.34.34.D01.1.454.CMB.1.raw
  modified_base (117)..(117): a, c, t, g, unknown or other
  misc_feature (117)..(117): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
  modified_base (516)..(516): a, c, t, g, unknown or other
  misc_feature (516)..(516): n is a, c, g, or t
tcagtacacgtgatcacgaccggtgctcgatttagatcgtctgtgttgggttggggagaactgctcagttaggacccagacggaaccatggaacgccccagcgcagcttctcttccncctgcctatctggcctcccgagaccaccagtggaagaaatgtgatgacgctagtctaccagcccaccttgtcgtgtacgttcgaccggaagggtaaacnccgccctacctcgttcgngaccgacggtccagtcgaagtgtgtcgnacgactagtcgctagacacgtacaacgtaccgcggcacgtcctaccgagtaccgtctaatactctacgccgactaactccgaccgaacggacgtacccagtctaccttacgacgtaacgccggttaattcggtacggtacgcgtaggttcggtagacgtacgattaccgtctaactcctaacgcactacgacgtccgtacgtctacggcttaacgtagtataacgtcgttactacttacgtttacttttaacgngttacgacttagtcgtaagtacgtaagtcgggtactacggtcggacgtaccgacggtacgaagtagtaacgaattaacgagtactgacggtcaacgccgttaactgtcgttacg

SEQ ID NO: 103499 - DNA, 727 bp, Homo sapiens
  misc_feature: GYAE6OF01C4D15.34.34.D01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (354)..(354): a, c, t, g, unknown or other
  misc_feature (354)..(354): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctccagacaccactggaagaaatggtgatggacgcagtctccagccacctgtctgtcgtcacggaagggaaancgtcaccctntcgngacgagggccaggtcaggtagttggtggacagtactaagttcgccgtacggaaccagacaacggaaacctcgggacccgacggtaccctacccgaacggtaccttaccgttaactaactttaaggtcggttanaaccgtaacttaccgtaaccggccgggtcccaggtacctaccgtacccgaaggtacccttagggttccgaaggtcggaacggtcggggtcgggttacgacgggtaactacggttacttcacgttactaccacgactaccgaacgtagtacgtacggcgtacgtagtaagtttacgttggaactagttagttacttacggactacgtaagttcgttacgcgtacaacgtacgaacgggttctaacgggtaccgtaaccggaagggtaaaccggagggtaaacaaaccggtaaacgaaaccgggttcgtaggtacccgacgttaaccgaaccttacgtacttcggttaaccctttccgtcctaccggtttccccg

SEQ ID NO: 103500 - DNA, 700 bp, Homo sapiens
  misc_feature: GYAE6OF01DTF4A.34.34.D01.1.454.CMB.1.raw
  modified_base (481)..(481): a, c, t, g, unknown or other
  misc_feature (481)..(481): n is a, c, g, or t
tcagtacacgtgatcacgaccggtgctcgatttagatcgtctgtggttgggtttgggggaggaactgctcagttaggacccagacggaaccatggaacgccccagcgcagcttctccttcctcctgcctactctggcctcccagacaccactaggaagaatgtgatcgacgcagtctccgacgcccaccctggtctggttcgtccgtaccggaaggggaaacgacgcccctacccgtcctccgtggacgacgggcccaggtcaggtggttggttcggcagtacctaacgttaccgccgtaggtaccagacagacgccgtacgccaggtccctccgcgcctcctactcgttcgtttcggcgtaccgcccgaccgacgggcctacgcggacctaccgaccccgagaccgtacggttacgaggtcggtacgtaggttcgggtcgtacgggaactacggttacctctactccgacactacgtacncgtacacgtgtacgtacgtacgtagtaacgtttgttactagttaacttacttacgtacttgacgtaagtacgattaacggtcgacgttacgtacgtacgggtgggtaccggtaccggttccgggaacggaacccgggtaaaggaacgggttaacggaaaccgtaacgaaccggttacgggtagtaccgtacctacggacctacgttacgtcgtttaccg

SEQ ID NO: 103501 - DNA, 789 bp, Homo sapiens
  misc_feature: GYAE6OF01BQ312.34.34.D01.1.454.CMB.1.raw
  modified_base (218)..(218): a, c, t, g, unknown or other
  misc_feature (218)..(218): n is a, c, g, or t
  modified_base (495)..(495): a, c, t, g, unknown or other
  misc_feature (495)..(495): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagacaccactaggaagaaatagtgatgacgcagtcctaccagcccaccctgtctgttcgtcgtaccgaagggggaaacncgaccctaccctctcctgcgacgggccagtcagtgtgtgcagacattacgccgtgtacagacaacgaaccgtggaccaggccctaccgagtaccgtcctctactctagtcgacctacgactacccgaaccggacggtacccctacgtcgtaccttacctacccgacgtaccggtaggttacggtgggtacgggtacggtagggttcggggtacggtaggggaacctaacgggttaccgtttaccacccgttaccgtaccaaccgttacaccggtacnccgttacgtccgtactacggtacgttaacgacgttaacgttctttaccgtacgtttacctttaactttttacggtaccgtacgtaacggacttacggttaacttaacggttaaacggttacgggttaccgggtcccgggtttaacggggtacccgggtttaaacccgggaaacggggaaaccggggttaaaccggtaaaggggtaaccgttaaaacgggaaaacccggtaaacgggttaacggttgggtacccgttaaccggactaaacccgtccgttacgttaccggttaccg

SEQ ID NO: 103502 - DNA, 672 bp, Homo sapiens
  misc_feature: GYAE6OF01ETTIS.34.34.D01.1.454.CMB.1.raw
  modified_base (152)..(152): a, c, t, g, unknown or other
  misc_feature (152)..(152): n is a, c, g, or t
  modified_base (667)..(667): a, c, t, g, unknown or other
  misc_feature (667)..(667): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccacgtgganaaatagtgatgacgcagtctccagccaccgtgtctgtagtctccgaagggaagacgtccaccctctcctgcgacgggccagccaggagttcgtagcgagactaacgttcggccgtcggtaccagtacgaacgaaaccgtcggaccgacggccctccgacggccttcctcctagtcgtaggtcggtcgactactacccgaccggaccggcctacgtcggtactacccgacgtaccgtacggttcgagtcggcgtaggtcgggtacgtacgggaactaagtaacttccgtaacttccgtaccaaccacgttacaacgccgtaaccgtccgttacggacttaacgggttactaaggttaacgtttacgtttcgtacgttaattttacgttaactggttacagtacgtaagttaactaacgtaccgtccgggtaccggtacgggttacgaccggaccggtaacggtacggagtaacggtactaacgtaacgacgtgacgtcagtcccagtatctcgttntaccg

SEQ ID NO: 103503 - DNA, 689 bp, Homo sapiens
  misc_feature: GYAE6OF01AZV0V.34.34.D01.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (682)..(682): a, c, t, g, unknown or other
  misc_feature (682)..(682): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctactctggcctcccagacaccacgtggagaaatgtgatggacgcagtctccagccacctgtctgtcgtcncgaagggaancgccctaccctctccgtgcgacgggcctaggtcaggtacggttggttcggactagactaacgttacgccgttacggtaccaggaccaaacggaaccgttcgggacccgtaacggccctacccggagtaccgttaccctactacgttacctagtcgtacctacgactacccgacggacggcctagtctaccgtcgtaccgacgaccggttagtcgtcggtacgcggtagggttcggtacggtacggaactggtactacgaccttactacgaccctatcgacgtaccgaacgtccgtaaagggtcctaaacgtttaaagtttaccgtttactaaaccttttaattttacgtacgtggttacctagtccgtaggtacgtaacaccgtacgtccggttacctcgtcgccgtcgtccggcgggaccgacgggtacaccggtagacggtaactaactaaccggtacggtcggtacacgtctaccnggttacc

SEQ ID NO: 103504 - DNA, 724 bp, Homo sapiens
  misc_feature: GYAE6OF01D11VO.34.34.D01.1.454.CMB.1.raw
  modified_base (700)..(700): a, c, t, g, unknown or other
  misc_feature (700)..(700): n is a, c, g, or t
  modified_base (706)..(706): a, c, t, g, unknown or other
  misc_feature (706)..(706): n is a, c, g, or t
tcagtacacgtgatcacgaccggtgctcgatttagatcgtctgtggttggggtttgggggaggaactgctcagttaggacccagacggaaccatggaagccccagcgcagcttctcttcctcctgctactctggctccagacaccactggagaaattagtgatgacgcagtctccagcccaccttgtcttgtcgtactccgaaggggaagacgcccacccttctcctgcgacgggcccagtcaggtaggtggttcggcagacctaacgttacgccgtacggtaccagacgaacgtaaacccgtcgggacccgtacggacccgttaccccgaaggtaccgttaccccgtactaactttaccgttacgttacgtaaccctaaccgtaccgttaccccggaacccggtacggggaccccttaaccgtccgtaccgtttaccgtacccgtacggtacccgttaacgggtttaccgaaggtcgggtacgtaggggttcggtacggtacggactaggttacttccaacgttcctaccaacgtactaccaggcctacgtcgtacgacgtagtctaaggtaactcgtttcgtactactttaacgttttactgttcgcgtacttacgtagttattaaggtacggtggtacggttacggtacggtaccggaacggtaacgacggtaaggtaagtaactacgaacgtacgnggttcncgtacatactcttcgtcg

SEQ ID NO: 103505 - DNA, 750 bp, Homo sapiens
  misc_feature: GYAE6OF01AHPXI.34.34.D01.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
tcagtacacgtgatcacgaccggtgctcgatttagatcgtctgtgttgggtttgggggaggaactgctcagttaggacccagacggaaccatggaaaccccagcgcagcttctcttcctcctgctactctggctcccagatatcaccggagaattgtgttgacactagtctccaggccacctgtctttgctacgagggaancgcctacctctccgtgcgacgggccagtcgagtagtagttaacncgcactctacgttcgcctggtaccagacaacgtaaaccgtggaccacgtccctaccagtcctacctacgtaattaacgtcggtacactaacgtaccgtaccggaccgggtaccctaggacctaccgtaccccgaagtaccgttaggttacgaaggttacggaccgttaagggtcggtacgagggtaactacgttacctacacgtccgtaccaacgtacacgtaccgacgtacctgggactccgtagtaacgttgttacgaacgtagttaacttacgttacgttagtaacctagttcggttaccgtacgtacgtaccgtaacgtaacgggttcggtaccggttaccggaaccgtaaacgggtaacccgtaaagggtaccgtaaaaacgtccggtaaaaaccgttcggttaagggtaccgtaccggttaacgaccgttaaccccgttagttacccggtttacggttaccctttagtaaccccgtttaccccggtcccgttaaacccg

SEQ ID NO: 103506 - DNA, 695 bp, Homo sapiens
  misc_feature: GYAE6OF01C24FN.34.34.D01.1.454.CMB.1.raw
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
  modified_base (463)..(463): a, c, t, g, unknown or other
  misc_feature (463)..(463): n is a, c, g, or t
tcagtacacgtgatcacgaccggtgctcgatttagatcgtctgtgttgggtttgggggaggaactgctcagttaggacccaggacggaaccatggaacgccccagcgcagcttctcttcctcctgctactctcggctccagacacctacgtggaagaaatgtgatcgacgctagtctcacgcctcctgtctgtcgtcgtcgaagggaancgcccaccgtctcctgcgacggtcacgtcagtgtgtcgcagtctacgttcgcgtacgtaccagacaacgtaaccgtgaccgngtcctcgaagtcctctanacgtctagctacctacnctacccgacgtcggcctagctcgttacgtacgagtccgtaggttacgacgggtgtacggttagggttggtccgacggtactacggtttacgtcctacttaccgctaactacgtcgacgacgtcgacctacgtaccgngttaacgtacgtaacgttacgttacgttacgtactttaactttacgttacgtacgttacgccgttaagttaacgttacggttaaacgttccgggtaccgggttaccgggttacgggttaccggtaccgggtaaacggaacgggttaacggtaaacgggttaacgtaaacggtaacggttaaaacgcggttacggcgtaacggtactaccgttaacgtacgttccgttaaccg

SEQ ID NO: 103507 - DNA, 638 bp, Homo sapiens
  misc_feature: GYAE6OF01EY5RX.34.34.D01.1.454.CMB.1.raw
  modified_base (172)..(172): a, c, t, g, unknown or other
  misc_feature (172)..(172): n is a, c, g, or t
  modified_base (498)..(499): a, c, t, g, unknown or other
  misc_feature (498)..(499): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagaccaccacgtggagaatagtgatgacgcagtcnccagcccaccctgtctgtgtctaccgagggaaacgacgccctacccgtctcctgccgagggccagtcagtagtgttcggcagactaacgttacgcctaggtaccaggacaacgaaaccgtcgaccgacgacctacccgaagtccgtacctctagtacctacgttcgacctactaccgtacccaccggaacggccctacgtacgtaccttacgttacccgaacgtccgtaggttaccgtagggtcgtccgtaagggttccggtacggttgggaaccgtagtaccgttcgtacgtcctacaaccgtctacgacgtcacgcctgacctnntagactnttcntacgttattactacgtcactacgtacgtataaccgtaagtcggtacggtcgtaggtacccgtcgaccgttaaggacgtaaggtacgaattaccgaatacgtggtacgcctanacccgtatntcttacg

SEQ ID NO: 103508 - DNA, 737 bp, Homo sapiens
  misc_feature: GYAE6OF01BE0HR.34.34.D01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagatgcccccggagaaattgtgttgacgcagtcgccagacaccctgtctctgtctccaggggaaagngccacctctcctgcaggtcagtcagtcgttcaacaccgtacttctccgcctggtaccngcagacgaccgtggccaggcctaccgaggcctcctcattcgtttggtcgccgtccgaccgacgggcccacgtggcctactcccgagtaccgtagggttccaaggttcggcgtaggttacggggtccgtagggtaacacggtacctttcaccgttccctaccaaccctagtaccgaagtacgtaacggtaccgtttacggacggtacccgttaggtaaacgttacgttttcgaacgttaacgtttaacgtttaactttaccgttacgttacgtacgtaaccgtaaacttacgttacggtaagaaccgtcgtaacgttacggggtacgggttccggtttaccggggaaccgtaaacggggtaaccggtaaaggggtaacggtaaaacgttaaccggtaaaaccggttaacggtacgggttacgggtccgtaacgtaccgtaaccgtacgttaccgttcgttaccgttccgttaacccg

SEQ ID NO: 103509 - DNA, 932 bp, Homo sapiens
  misc_feature: GYAE6OF01E2ZQ6.34.34.D01.1.454.CMB.1.raw
  modified_base (153)..(153): a, c, t, g, unknown or other
  misc_feature (153)..(153): n is a, c, g, or t
  modified_base (602)..(602): a, c, t, g, unknown or other
  misc_feature (602)..(602): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctccagacaccagtggaanaaatgtgatcgacgctagtctccagccctacctgtcgtgtacgtccgtaccggaaggggaaaacaccgtcccctaacccgttcgtccgtagggacccgtaacggggtaccccttaaggtacggtaagggttaaggttttcgggttaccgggaacgttaaaccggtaacccgtttaaaaaccggtttttccggaaccccggttttacgggtaaccccgaaagggaaccgtaaaaccggtaaaaccccggttcggggaaccccgtacgggtaccccttacccggaaaagggttccctttacccctagttaccttacgttaacgtccggtaacctaaccgtacccgttaccccgaacgggtaacccgggacccttagttaccgtaccttaccgtaccgaacgtccgtacggttacgaggtcggtagtacgggttggtaaccgtaggtaacgngtttacccgtacaccgttcctaacgaacctagtaccgaacggtccacggtccgtacggtacgttacgtacgttacgacgtttacttccgttacggtaccttttaagtttaaccgttacggtaacgtccgtaaggttaaccttaacggttaacgttaaacggttacggggtaccgttaccgggttacgggttaccggtaaaccgggacgttaaaacggggtacccggaaaagggttaaacccgttaaacggaaaccgttaaaacggtcggttacgggtaacccgttacggtaacccgtaaccgttaccgttaaccgtccgttttaacccgg

SEQ ID NO: 103510 - DNA, 776 bp, Homo sapiens
  misc_feature: GYAE6OF01AVN9M.34.34.D01.1.454.CMB.1.raw
tcagtacacgtgatcacgaccggtgctcgatttagatcgtctgtgttgggtttgggggaggaactgctcagttaggacccagacggaaccgatcggaaggccccagcgcgacgtcttcgtcttccctcctgctactctcggctcccagaccaccactggaagaaatagtgaatcgacgcgtacgtcctccacgcctacctgtctggtgtcctaccgaaggggaaatcggccctaccttctccgtcgacgtacgggacctagtcaggtaggtggttggaccaggtacctaacgttacgccggtacggtaacgacgacctaacggaaccggtcggaccgacggtcctaccgacgtaccttcctactactcgtactctacctactacctaccgaccgcggaccactacgtacctacgtccgacgtaccgtaggtacgtacggtcggtacgtagggtcgggtacggtaggtacgtacggttacgttacctacgtacctacgtacctacgtacggtacggactaccggtaccgtacgtacgtacgttacgtaacgtaacgttcgttaccgtaccttaccttaacgtttacgttacgtaccgtaacgaccggttaaccgtaacgttaacgttacggtacgggtacgggttaccggtacgggttacccggtaacgggaaaccggtaaaccggggtaacggtaaacgggtaaccgtaaacggttaaaccggtaagtaccggttacggacggtaccctacggtacctaccgttcgtaccgttacg

SEQ ID NO: 103511 - DNA, 690 bp, Homo sapiens
  misc_feature: GYAE6OF01EP70Q.34.34.D01.1.454.CMB.1.raw
tcagtacacgtgatcacgaccggtgctcgatttagatcgtctgtggttgggtttgggggaggaactgctcagttaggacccagacggaccatggaagccccagcgcagcttctcttcctcctgctactctggcctcccagacaccactggagaaatagtgatgacgcagtctccagcccacctgtcctgtgtctccgaaggggaaagcgccctaccctctcctagcgaggggccagtcagtagttgttcggcagcaacgttagccctaggtaccagtcgaacgaaaccgtcggaccacggcctacccgagacgtcctacacgtactacgtcgacctaactacctacccgaccgacgggtaccctaacgtccgtacttaactccgagttaccgttacgggttcgaacgggttcggacgtagggtcgggttacgtacggggaactagggtacgtttccaaccgttccactaaccgtacgtaccgacgacctacggcccttggactacgtacggtagaacgttcttatccgtaacttagttttacttactcggttacacgtacttaacgtacgttaaagttacgggtcggttaccggtacgggtaccgttacgggaaccgggtaaacggaacgtaacgggaagtaaacgtacaaacggtaccgtagtacggtctacgaccgactcggtctacg

SEQ ID NO: 103512 - DNA, 1076 bp, Homo sapiens
  misc_feature: GYAE6OF01EVT65.34.34.D01.1.454.CMB.1.raw
tcagtacacgtgatcacgaccggtgctcgatttagatcgtctgtgttggggtttgggggaggaactgctcagttaggacccagacggaaccatggaagccccagcgcagcttctcttcctcctgctactctggcctcccgagatccgcccccgggaaggtaaactttggtgttgacgcgagtcgccaacgacctaccctgttcctcgtcgtcctacggaagggaaacgcgacccaccctctccgtcgacgtacgggtcacgtctacgtacgttacctaaccgtaccgttacctttccttccggacccttcggggtaccaacgtaccgaacggaacgtaccgtccgggacccgacggtaccccgtacccgacggtaccccttcccgtacgttacgtttcgggtttaggtcccggtacccggtaaccccggtaccggggaccggggtaccctaccggttacggtacctaacccgtaccccggaagtacccggtttaggtttaccggagggtaccggtacggtacgggggttacgggttacgggttaccgggtaacgtaacggttcccttaaccgttaacccgtttaccccgaccgttaaaccgtacgttaaaccgtacggtaacccgtaacggttaacggtttacggaaccggtttaaccgtttaaacggttaacggtttttaaggtttaccgtaaacggtttaacggtttaaccgttttaaacggttaccggttttaaaccgtaaccggttaaacgaaacccgttttaaacggtacgtaaaccccggtaccggtaaacccggtacccgtttaggggttacccggggtttccggggttaaaccccgggggtttaacccgggaaaaccccggggggttaacggggtaaaaaccccggggtaaaagggggtttaaaacccgtaaaaacggtttaaaaccccgggggtaaaaccggttaaacccgggttacggggtacccgggttacccgtaaacccggtttaccccgggtaaacctttacccggttttaaagggttttccgttttaaaccccgggttaaccggttttaaaccccccccgg

SEQ ID NO: 103513 - DNA, 771 bp, Homo sapiens
  misc_feature: GYAE6OF01DG638.34.34.D01.1.454.CMB.1.raw
  modified_base (226)..(226): a, c, t, g, unknown or other
  misc_feature (226)..(226): n is a, c, g, or t
  modified_base (371)..(371): a, c, t, g, unknown or other
  misc_feature (371)..(371): n is a, c, g, or t
  modified_base (739)..(739): a, c, t, g, unknown or other
  misc_feature (739)..(739): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacacccacgtggaagaaattagtgatgacgcagtcctccacgcccacccgttgtcctggttacgtacctaccggaaggggaaaacncgaccctaccctccttccgtcgcggacggaccagtacgtacgtaggtcgtttcggcgacctaccgtaacgtaccgtcgtaccggtaccgaacgtacgaaacgtaaccgcgtaccgacggaccgtcccacgtaccgcccctttaancttaacgttgtcgaccttaacctaaccgtacccgacccggtacgtcccgtactacgtccgttaccttacgaccgtaacttcggtacggtagtacggtccgtagggtcggaacggttcggacgtacgtaagttcctccctacgacctacgactcgaccgcgtcgacgtctacgtaagtacgttacgtacgtatttaccccgttggtaccttttaacgtttacgttaacttcgtacgacgtacttaaccgtagtttaacgttaccgggtacggttacggtacggttaccgtacccggggtaaactaccggggaaacccgtttaaagggtagtaaaccggtaaggaacccgttaacggtagtcccggttanacccgagttttaaccgtcgttcggtttacccg

SEQ ID NO: 103514 - DNA, 748 bp, Homo sapiens
  misc_feature: GYAE6OF01B19TS.34.34.D01.1.454.CMB.1.raw
  modified_base (114)..(114): a, c, t, g, unknown or other
  misc_feature (114)..(114): n is a, c, g, or t
tcagtacacgtgatcacgaccggtgctcgatttagatcgtctgtgttgggtttgggggaggaactgctcagttaggacccagacggaaccatggaagccccagccgggggggancttctcttcctcctgctactctggctcccagacaccactggagaaatagtgatgacgcagtctccagccaccctgtctgtgtctccgaggggaaagcgccaccctctcctgcgagggccagtcagagtgtggcagcaacttgcctggtaccagcagaaaccgtggccaggcctcccaggacgtcctcatctatcgactacactacccaccgacgggccctacgtcgtccttaacgtttcccgaacgtccgtaggtttccgaagggttcgggacgtaagggttcggggttacgtacggggaactaggtacgtttccaccgttctaccgacccgtagttccgaacggtccaacggtcccttacggaccgtaacggttaccgttaaggtaacgttacgtttaccgtacgggttaccctttaacgttttttaacgtttaccgttcggttacaacggttaccttaacggtttaacttaaaggtaacgggttcgggtaccccgggttagggtacccggtttaccggggaacccggtaaacggggtaaccccgtaaaggggttacggtaaaagtaaccggaaaacggtaacgttgggttaacggtccgttacgaacccgtaaccgtagttccgtttaccgg

SEQ ID NO: 103515 - DNA, 859 bp, Homo sapiens
  misc_feature: GYAE6OF01EFX1L.34.34.D01.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
tcagtacacgtgatcacgaccggtgctcgatttagatcgtctgtgttgggtttgggggaggaactgctcagttaggacccagacggaaccatggaagcccagcgcagcttctcttcctcctgctactctggctccagacaccacgtgganaaatagtgatgacgcagtctccagccacctgtctgtgtctacgaagggaancgccacctctcgtgcgaggccaggtcagtgtgtggcagactaacgtcgcgtaggtaccagtacaacgaaccgtcggaccgacggtcctaccgaagtccgttaccctacgtacttaccgtaacgtacgtacctttaaccacccgttacccgaacccgggtacgggtaccccttaacgtacggttaaccttaaccggttacccggtaaccggttacccggttaacggtttaccggtaacggggttaccgggtacgggttaacggggtttcgggggttaaccgtgggggttaaacctacgggtttaaccgtttaccgaccctttacccgttaacctaaccgtacggtaaccggtacgaaccgtacggtaccgttaccgggacgttaacgtacgtaaacgtaacgtttaactttcgtaacgttaacgttttaacttttactaccgttacgtactaaccgggtagttaaccgttaaggtttaaccggttagggtaccgggtacccggttaacggggttacccggttacccgggaaagggtaacccggttaaaaccggttaaaggggaaacccgtaaacgttaaaccggtaacccgggttaaaggtcggttaaaccggtcgttaaccggaaaccgttacgtttaacggttcccgtttaaacggg

SEQ ID NO: 103516 - DNA, 778 bp, Homo sapiens
  misc_feature: GYAE6OF01BC6MY.34.34.D01.1.454.CMB.1.raw
  modified_base (224)..(224): a, c, t, g, unknown or other
  misc_feature (224)..(224): n is a, c, g, or t
tcagtacacgtgatcacgaccggtgctcgatttagatcgtctgtggttggggtttgggggaggaactgctcagttaggacccagacggaaccatggaacgccccagcgcagtcttctcttcctcctgctactctggcctacccagaccaccacgtaggaataaagtagtgatgacgtcagtcctccacgccctacctgtctgtcgtcgaccggaaggggaaacnccgccctacccgtccgtccgtcgacggacggccagtacgaggtaggtggtcgacagtaccgtaacgtacgccgtaggtaccgaagacgaacgaacgtcggaccgacggccaccgacgtcgtacctactacgtctagtacacctacacctacccgaacggaccgtaccctagtaccgtaccttacgtacccgtaacggtaccggtaaggtaccgtaaggggtcgtaacggtacggggtttcgggtacggtaacgggtaccttaggttaccttaccgaacttaccgtacctaacgtacgtaccgacgtacctaccggtcttaggaccgttaagtacgttaagacgttactttaccgtacgttaaaccttttagttccggttaactacggtaacgacgtaacgtttaactaagggtttaaaccggttacgggtccggttaacccggtagggtacccgggtaacgaaccgggtaaacgggtaaacgtaaggtaaaccgtacgaaacggttaacggtcggtaacgacggtacctactaacccggtatcgttccgtaacg

SEQ ID NO: 103517 - DNA, 749 bp, Homo sapiens
  misc_feature: GYAE6OF01C3SW0.34.34.D01.1.454.CMB.1.raw
  modified_base (172)..(172): a, c, t, g, unknown or other
  misc_feature (172)..(172): n is a, c, g, or t
  modified_base (204)..(204): a, c, t, g, unknown or other
  misc_feature (204)..(204): n is a, c, g, or t
  modified_base (722)..(722): a, c, t, g, unknown or other
  misc_feature (722)..(722): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggaagaaatgtgaatgacgcagtcnccagcccacctgtctgtgtcaccgagggaaancgcccacctctcctgcgacgggccctaggtcaggtacgttggttcgacgagtacctaaacgtttcgccgttacggtaccaagacgaacgaaaccgtcggaccacggcctacccgagtacgtcctactaacgttctactcgtacctacgtacctccgaaccgtacggacctacgtcgtaaccttacctacccgagtaccccggtaggttcgaacgggttcgtaccgtacgggtcgggttaccgtacgggggtaactaacgggttaccgttaccctaaccggtttaccctaaccgtaaccctaacgttaccggaacggttacccggacgtacccccgttaggtaacccggtaagtttaaccggtaaggtaaaccgtttaacgtttccgttaacgtaaccttttacggttttaactttacggtcgtacgtaacgtacgtaacgttagttaaacggtaggttcggtacgggtggtaccgtacggaaccggtaaacgacgtaaggtaacggaaacacggaacncgtaggcgtactacaccactgtctacg

SEQ ID NO: 103518 - DNA, 879 bp, Homo sapiens
  misc_feature: GYAE6OF01B6ZMJ.34.34.D01.1.454.CMB.1.raw
  modified_base (98)..(98): a, c, t, g, unknown or other
  misc_feature (98)..(98): n is a, c, g, or t
  modified_base (129)..(129): a, c, t, g, unknown or other
  misc_feature (129)..(129): n is a, c, g, or t
  modified_base (208)..(208): a, c, t, g, unknown or other
  misc_feature (208)..(208): n is a, c, g, or t
tcagtacacgtgatcacgaccggtgctcgatttagatcgtctgtgttgggtttgggggaggaactgctcagttaggacccagacggaaccatggaacnccccagcgcagcttctcttcctcctgctacnctggctcccagacaccactggagaaatgtgatgacgcagtctccagccacctgtctgtgtcctaccggaaggggaaacncgcccaccctctcctgcgacgggccagtcgaggtatcggtggacacgtacaacgttcggccgttacggtaaccgacgtacgaaaccggtaaaccgtcgggacccgtacggccctaccccgaaggtaccttccctacaacgtttaccgtacgttacgaccttaaccgacccttacccgaacccggaccgggtacccctaacggtcgttacccgtttacgttaccccgaacgggttacccggttaacgggtttaccgtaacggggtttaccgggggtaccgttaacgggggtttacgggggtttacccgtaacgggggggtaacccttaaaggggtttttaacccggtttacccaaaccggttttaccccggttaaccctaacccggttaaccgttacccgaaccggtaccgtacccggttaaccccgtaggtacccgtaacggttaccgtaacgtaacgttacgttttccgtaacgttacctttaactttttacgttacgtacgttacgtacgtaaccgttacgtttaacgttaaacggtccgggttaacggtcccggttacgggtaaccggttcggaaccgggtaaccgggaacgtaacggggtaaacgaacgttaacggaaacgtcggtacggtacggtaccttacggaccctacgttgtcccgttacgg

SEQ ID NO: 103519 - DNA, 796 bp, Homo sapiens
  misc_feature: GYAE6OF01EMJ5L.34.34.D01.1.454.CMB.1.raw
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (546)..(546): a, c, t, g, unknown or other
  misc_feature (546)..(546): n is a, c, g, or t
tcagtacacgtgatcacgaccggtgctcgatttagatcgtctgtggttggggtttgggggaggaactgctcagttaggacccagacggaaccatggaacgccccagcgcagccttctcttccgtcctgctactcgtggcctacccgagaccacctagtagggaataaagtgtagatgaccgtntacgtcnccacgccctaccgttgtcctaggtcgtaccgacgggaagggaaacgtccaccctacccttctacgcggaccgtacggcctaggtcgaagttggtggtcggactacgtaactaacgttcgacgtacggtacacgacgaaacctacggcgtaccgacgtccctaacgacgtctaccttagacttacgtactaacgaccctaactacgccccgaagggttcccggaactcgtagttaccgtaccccagggtaccaccggtttaaggtaccagggtaacggtcccgggtaagtttcggggtaccgtaacggacgtaccgttaaccggtactaccctaaccgtcgtaacgactaccggacnccgtctaccggtactacgaacgttaggtacttaacggtaccttacgtactttacgttttacttaacgttaccgtagtacggtacgtaaccgttaagtaaacccgttaagggtccggtaaccggtacggttaaccggtacggtaaccgggtaaaccgggtaacggtaaacgttaaacgggacgttaaaaccgtaaccggaaattaccgggtaaacgtcgtaactaccggttacacgttacctggtttaccc

SEQ ID NO: 103520 - DNA, 927 bp, Homo sapiens
  misc_feature: GYAE6OF01CTC3K.34.34.D01.1.454.CMB.1.raw
  modified_base (99)..(99): a, c, t, g, unknown or other
  misc_feature (99)..(99): n is a, c, g, or t
  modified_base (182)..(182): a, c, t, g, unknown or other
  misc_feature (182)..(182): n is a, c, g, or t
  modified_base (234)..(234): a, c, t, g, unknown or other
  misc_feature (234)..(234): n is a, c, g, or t
tcagtacacgtgatcacgaccggtgctcgatttagatcgtctgtgttggggtttggggggaggaactgctcagttaggacccagacggaaccatggaanccccagcgcagcttctcttcctcctgctctctggcctccagacaccactagggaagaaattagtgagtcgaccgctacgtccnccacgccctacctgtctgtcgtctacggagggaaagcgcccaccctctccgngaccggacggccagtgacggtagtggttacggctacggacctaacgttacggccgtacgggtaacccagtaaccggtaacgtaaaccggtcgggccctacgggtaccctaccccgtaggtaaccgtccctacgtactcctaacgtcaaccgttaacccaccgtaccccgaaccgggtacggtacccctacggttacttaccgttaaccttacccggtaagggtaccccgttagggtttacccggagggttacgggtccggttaacggggtttcgggttaacggtacgggggtaacgtaaccggtttctaccgttaaccgtaccctactaaccggtaccgtaaccggacgtaccggtaccgccgttacggtaccgtaacgggttaccggtaagggttaacttaacccgtttttcggtaaccgtttaaacggtttttaaccgtttacccgtttagttaccggtaaccgggtttaccaacgtttaacggtttaaccgggttttaacgtcgggggttacccggttacgggttaccgggggtttaaaccggtaaaccccgggtacggggggtaaaaccggtaaacccggggttaaagggtaacggttaaaaccccggtaacggtttaaaccgaccggggttacgttaccggtaccgggtaaactcccggttaaacgtccgtttaaccggtttaccccg

SEQ ID NO: 103521 - DNA, 862 bp, Homo sapiens
  misc_feature: GYAE6OF01A3XEA.34.34.D01.1.454.CMB.1.raw
  modified_base (243)..(243): a, c, t, g, unknown or other
  misc_feature (243)..(243): n is a, c, g, or t
tcagtacacgtgatcacgaccggtgctcgatttagatcgtctgtgttgggtttgggggaggaactgctcagttaggacccagacggaaccatggaacgccccagcgcagtcttctcttcctcctgctactctaggcctccagaccacctacgtaggaagtaaatagtagacgtgaaccggctagttcctccacgacccctacccgtggttccgtggtcgtacctaccgggaagggggaaaacnccgaccctacccgttccttccgacggcggaacgggccctaggtactaggtaggttcgttggactaaggactaacgttacgccgttacggaaccagactaacggaaccgtcggacctacggtcctaccgtaaggcccgtttacactaacgttctacgtacgtaaccctacgtaccgtacccgaacgggaccgtacctacttcggactaccgttaccgcgtaaccgtacggtagtacgtacggagtacggtcgggtacgtaggactacgggtcgtttacaccctcgtaccgaactacgtacaaccggtcgaacgtccgtacgtacgtacgtacgtagtaaccgttacgtttacgtacgtttaccgttttaagttttaaccgtagttaaccgtacgtaacgggttaaccgtttaaacgttaacggttaaacggtaccgggtttaacggggaccgggttacgggttaaccggttacccgggggaaacccggttaaacgggggtaaaccgggtaaaaccggttaaacgggtaaaaaccgtttaacggtaaaacgggttaccggtacggtaacgttaaccggttaccgaaacccgttaaccgttaccgttaaccgttttaaccgg

SEQ ID NO: 103522 - DNA, 888 bp, Homo sapiens
  misc_feature: GYAE6OF01CB9PR.34.34.D01.1.454.CMB.1.raw
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (483)..(483): a, c, t, g, unknown or other
  misc_feature (483)..(483): n is a, c, g, or t
  modified_base (615)..(615): a, c, t, g, unknown or other
  misc_feature (615)..(615): n is a, c, g, or t
tcagtacacgtgatcacgaccggtgctcgatttagatcgtctgtgttggggtttgggggaggaactgcttcagttaggacccagacggaaccatggaagccccagcgcaggcttctcttcctcctgcgtactctggcctacccagacaccacgtaggaacaaatggagtaactggaccggactaagttccaccgacgtacccgtaacccgttgtcctggtcgttaccgaccggaaaagggggaaacncggacccctacccgttacgtccnggaccgtaaggggtaccccaaaggttccgaaggggtaagtttcggttaggaaccttacggacctaaacgtttcggccgttacggtaacccgagtacgaaacgaaccggtcgtaccgacggtacctaccgtaggtacctactacgacttaccgatacgtacctaactaccgaacctaccggtacggacctaacgtgtaaccttacgttaaccgngtaccggtacgtacggaacggtgggtaccgtaagggttcgggtaacgttacgggacgtaagggttaaccgtccggtaccggttactaccgttacgttaacaccggttacaaccggttaacgtaccccgggtntaaccgggtaacgtaccgttaacggtacggttaaactttccgacggtttaaccttaacgttttacgtaaacgttccgacgttaacgaccgtttaaccgtaaccgttaagggttaccgtacccgggtaccggttagggtacccgttaccgggaaacggaaccggttaaacggaacgggttaaacgaaaccggtttaaaccggaaacggtaccgttaaaccgggcgttaaaccggacccgggtaacccaacgggttaaacgttcgtttaacccgg

SEQ ID NO: 103523 - DNA, 826 bp, Homo sapiens
  misc_feature: GYAE6OF01AGSQH.34.34.D01.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (454)..(454): a, c, t, g, unknown or other
  misc_feature (454)..(454): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaacacgtggagaaatagtagatggaacgctagtcctaccagcccacctgtctggtcgtctaccgaggggaacncgcccaccgtctcctgcgagggtccagtcagngtgtgcngacacttcgcctggtaccngctaacgaaccgtgccaggcctcgagtactcctnatctagcncctaagactcccgaacgcgggccctaacgtcgtaccttaccgttacccgacggtaccgtaacgggttacctgggtacggtaaccggtacggggtttggggttacccgaacggggtaacaaacgggtttcgtttaacccnctttacccggttacccaaccggttacaccggtaaccgggtccgtaaaccgtcccgggttagtcccgttaaacggttaccggtaacgggtaattttaacccgtccgtttacggtaaacccttttaccggtttttaacgtaccggtttacgaacccgaacggtttacgttaaacggtttaaccggtaagtttaaaccgggggttccggtaacccgggtttacgggttaccccggttaaaccggggaccgggtaaaacgggtaaacccggttagggttaaacgggtaaaccctaacgggtaaaccggaacggttttcgggaccggttaaaccgccggttaaaccctacccgggtttacccgttggtttaaccccg

SEQ ID NO: 103524 - DNA, 802 bp, Homo sapiens
  misc_feature: GYAE6OF01CG5I6.34.34.D01.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (384)..(384): a, c, t, g, unknown or other
  misc_feature (384)..(384): n is a, c, g, or t
tcagtacacgtgatcacgaccggtgctcgatttagatcgtctgtgttgggttgggggaggaactgctcagttaggacccagacggaaccatggaacgccccagcgcagtccttctcttcctcctgctactctcggcctcccgagacaccacgtggaagtaaactgtgatcgacgcgtacgtcctccgacgccctaccgttgtctgttcgtacctaccggaaggggaacnccgaccctcctcgtccnggacgacgggtacagtcgagttggtgtacgacgagtactaacgttacgccgtacggtaccacgacgtaaacgaaccgtcggaccgacgtccgtaccgaaggtaccgtcctactacgtacttacgtacgtacctaaccnccgtaacccgacgtaccggcctaacgttccgtacttaacccgtacgtaccgtaccgttacggttcgacgggttcggacggtacggttcgggtcggtaggttaccgacggttaacgtttacctaccgttctacccgtaacgtaccgacgtacggccgtacggtaccggtcgaaccgttagtaccgtaagtacgttcttacgtcctacgtttaacgttctacgttacacgtacgttaacgtacggttaacgttaacgggttcggttaccgggttacgggtaccggttaacggggttacccgggaacccgggtaaacgggtaacgggttaacggtaaacggtaaaccgttaaaccggtaaaccggtaacggttacgggtcgttaaccgtacccggaacttaccgttaaccgtcggtttacc

SEQ ID NO: 103525 - DNA, 1000 bp, Homo sapiens
  misc_feature: GYAE6OF01CSJWG.34.34.D01.1.454.CMB.1.raw
  modified_base (200)..(200): a, c, t, g, unknown or other
  misc_feature (200)..(200): n is a, c, g, or t
tcagtacacgtgatcacgaccggtgctcgatttagatcgtctgtggttggggttgggggagaactgctctagttacggacccagacggaaccagtggaacgccccagccgcagtccttctcttcctcctgcctactcgtggacctccaagaccacccgagtaggaagtaaagtggtagacgtaggaccgccgacgttccnccacgccctaccgtgtccgtgtcgtaaccgtacggaaaggggtaactccgccctaccgtcctacgacgcggtaccgggtacacggtagtaggtcgttacgggtcaaccgtacggtaacttaccgttaccggtacgtccggtaaccgtacggaaccgtaaacggtaaccggaccggtacccggacggttacccaaccggttaccgtaccgtaccggttaccgttaacgtaccttacgttacccggacctttaaaccgaacccggttaaccccggtaaccgggaaccgggttaaacccttacgttaccccggtaaccgttttaaaacccgcccgggtaaaacccgtttcgggttaaacggtttaccgacccggggttaaacggccgggttagggtaacccgggtttcggaaccggtacgttacgtaaacggtccctacgtaaacccgtacctaacccccgtagtaacccttcggaacccggttacgaacggtacccggttaacgttacccgaagggtaaaccggttaccttaccgggttttaacctaaccggttttaaccctttacgttttaaaccgggtttacctacggttaaccggttaaccgggtttaaccttaaacggtttaccgggggtaaacttcccggggttaaccggtttacggggtaccggttaaaccggttacgggggtaaaacccgtaaggggtaaccccgggtaaaaggtacggtaaaacccgtacggttacgggtaaaccggttgtacccgtaacggacctttaaccgaccggttacgttccgttaccg

SEQ ID NO: 103526 - DNA, 846 bp, Homo sapiens
  misc_feature: GYAE6OF01AG976.34.34.D01.1.454.CMB.1.raw
  modified_base (154)..(154): a, c, t, g, unknown or other
  misc_feature (154)..(154): n is a, c, g, or t
  modified_base (493)..(493): a, c, t, g, unknown or other
  misc_feature (493)..(493): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagaccaccacgtgganaaatagtgatgacgcagtcctccagccctaccctgtctgtcgttaccacggaagggaaacgccgccctaccctcgtaccgtggacgtacggcctaagtcgagtaggttgtaggacctacggtacctaacgttacgccgttaggtaacccgagtacaaccggtaaaacccttcgggacccgtacggcccgtaccccgacggtaccgttaccccttggaacctttcgtaacgtgttaccctacgaccttacccgaccgacgggtaccctcgtgacttacctcgacgtccgtacggtaccgagtcggacgtgggttacggtgtacggactacggtacttacncctacgtaccacgtacgtacgacgtcgacgtccgtacgtacgttacgtacgtacgtaacgttaccgttaccgtacttaccggggtttacttttaaccgtttacgtacgttaccgtacgttaaccgttaacgttaacgttaacggttaacgggttaccgggttacccgggttaccgggttaacccggttaaccggggtaacccgggtaaaacccgggttaaaccgggtaaaccgggggttaaacggtaaacccggttaaaaccggttaaacccggttaacgggtaacccgggttaccggtaaccggttaaccggaacccgtaacccgtttaccgttaaccgtttttaaccccgg

SEQ ID NO: 103527 - DNA, 827 bp, Homo sapiens
  misc_feature: GYAE6OF01DSQ57.34.34.D01.1.454.CMB.1.raw
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagaccaccactggaagaaatagtgagtgaccgcagtcctccacgcccaccctgtctgtcgtcgaccggaagggaacgccgccctaccctcctccgtgcgacgggcctagtcgagtagttggtcggacagactaacgttaccgccgtacggtaccagaccgaacgtaaccgtcggacccgacggtcccgtacccgagtaccgtcctactacgttctaagtccgtaacctaccgtaccgtaccccgaaccggaccggtacccctaccggtcgttaaccctaccgttacccgaacggtacccgttaggtttaccggtacgggtacgggtaccggttacggggtcgggttaccggtaacgggtaacgtacggttaccttacccgtacccgttaccgaaccgtaacctaagtacccggaccgtcccggtaaccgtcccgtcggtaacgttacggtaccggtagtaacgtttcctttaccgggtactttaacgttttacttttacgtaccggttcgtaccgtaacgtaaccggtttaggttaaaccgtaacggttaacggggtcccggtaacggggttacggtaacccggtaccggtaaacgggaaaccgggttaacgtaaacgggttaaccgtaaaacgtaaccggtaacgtacggtcgaccgtacggtcaacccttcgtacgtttcgtaccg

SEQ ID NO: 103528 - DNA, 795 bp, Homo sapiens
  misc_feature: GYAE6OF01BXURA.34.34.D01.1.454.CMB.1.raw
  modified_base (221)..(221): a, c, t, g, unknown or other
  misc_feature (221)..(221): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagaccaccacgtaggaagaaatagtgatcgacgcacgtcctccacgccctaccctgtctgtcgtcctaccggaaggggaaacncgcccctaccctctacccgtggacgacgggtccaggtcgaggtggttgttcggacctaacgtacctaaacgttcggcccgtacggtaaccgagaaccgaaccgtaaacggtcggacccgacggtcctacccgaggtacctccgtactacttctagtcgaccttaacgaccgtcccaacggtacggaccctacgtcgtaaccttacgtacccgacgtaccgtaggttcgacggttcggacgttacggggtcggtaacgtacgggactacgggttaccttccgacgtttccaccgtacctacgtaccgacgtctaccggtccctaggtaccgtacgtaacgtaccgtaacgtttaccgttcaccggtttaacctttaacgttttacttaccgttggtaaccgacgttaacgttaacgttaacggtaaacggttcggggtacctaccgggttacggtacccgggtaacggaaccgggtaaaccgaaccgggtaacggtaaacggtaaaccgtacgtaaaacccggttcgggtacggttacgtaacctacgtacccctaacgttggtaacccttccgg

SEQ ID NO: 103529 - DNA, 279 bp, Homo sapiens
  misc_feature: GYAE6OF01EJL82.34.34.D01.1.454.CMB.1.raw
  modified_base (97)..(97): a, c, t, g, unknown or other
  misc_feature (97)..(97): n is a, c, g, or t
  modified_base (253)..(253): a, c, t, g, unknown or other
  misc_feature (253)..(253): n is a, c, g, or t
  modified_base (257)..(279): a, c, t, g, unknown or other
  misc_feature (257)..(279): n is a, c, g, or t
tcagtacacgtgatcacgaccggtgctcgatttagatcgtctgtgttgggtctgggacagagttcactctcaccatcagcagcctgcagtctgaagnttctgctactttatactgtcagcagtactaataggtcggccgtggacgttcggaccaagggaccaaggtggaaatcgaaaacgactgtggctgcacatctgtcttcatcctcccgctatctagatcgacgtgtactgacgcggtctggcgaggcanatgnnnnnnnnnnnnnnnnnnnnnnn

SEQ ID NO: 103530 - DNA, 147 bp, Homo sapiens
  misc_feature: GYAE6OF02GXT1C.34.34.D01.1.454.CMB.1.raw
  modified_base (147)..(147): a, c, t, g, unknown or other
  misc_feature (147)..(147): n is a, c, g, or t
tcagtacacgtgatcacgaccggtgctcgatttagatcgtctgtgttgggtttgggacagggtctgcgaaggcttcaccagtcctgggctgcctggtcaaggactacttccatcacgtgtactgagcgggctggcaaggcgcatagn

SEQ ID NO: 103531 - DNA, 247 bp, Homo sapiens
  misc_feature: GYAE6OF02F17TT.34.34.D01.1.454.CMB.1.raw
  modified_base (246)..(247): a, c, t, g, unknown or other
  misc_feature (246)..(247): n is a, c, g, or t
tcagtacacgtgatcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccatcacgtgtactgagcgggctggcaaggcgcatagnn

SEQ ID NO: 103532 - DNA, 175 bp, Homo sapiens
  misc_feature: GYAE6OF02GOA6O.34.34.D01.1.454.CMB.1.raw
  modified_base (173)..(175): a, c, t, g, unknown or other
  misc_feature (173)..(175): n is a, c, g, or t
tcagtacacgtgatcacgaccggtgctcgatttagatcgtctgtgttgggtttgggggaagaggaagactgacggtcccccaggagttcaggtgctgggcacagcggccctgggctgcctggtcaaggactacttccatcacgtgtactgagcgggctggcaaggcgcatagnnn

SEQ ID NO: 103533 - DNA, 504 bp, Homo sapiens
  misc_feature: GYAE6OF02GONZ0.34.34.D01.1.454.CMB.1.raw
  modified_base (394)..(394): a, c, t, g, unknown or other
  misc_feature (394)..(394): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccagttcagtggcagtggtctgggacagagttcactctcaccatcagcagcctgcagtctgaagtnttctgctactttattactgtcagcagtctaataagtgccgtggacgttcggcctaagggaccaaggtcggaaatacgaaacgtaactgtcggactgaccacctatcttcg

SEQ ID NO: 103534 - DNA, 509 bp, Homo sapiens
  misc_feature: GYAE6OF02H9DBY.34.34.D01.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttagcggctacttagcctggtaccagcagaaacctggccaggctcccaggctctcatctatgatgcgtccaacngggccatggcatcccagccaggttcagtgcagtgggtctgggccagactttcactctcaccatcagcagcctagagcctaaagattttgctaaatttattactgtcagctgcgtagcaactggccctcccgttgacgcgccgttcggccgagggaccacgacgttggagtaacttaaacgactggtggctggcaccatcg

SEQ ID NO: 103535 - DNA, 952 bp, Homo sapiens
  misc_feature: GYAE6OF02IPPQV.34.34.D01.1.454.CMB.1.raw
tcagtacacgtgatcacgaccggtgctcgatttagatcgtctgtgttgggtttgggggaggaactgctcagttaggacccagacgggaaccagtaggaaccgcccagcgcagtccttcttccttcctcctgactactcgtggccctacccgagaccacctacgtgggaaagtaaataggtagatcggaccgactacgttcctaccgacgcccctacccgttgttctggttcgtcctaccgggaaagggggaaagccgacccctacccttcctccgtgaccggacgggcctagtcaaggtaggttggttcggacacggaccttaaacgttcgccgttacggtaaccagacgaaacgtaaaccgtcggaccgacggtccctacccgaaggtaccgttccctactacttacttaacgtcgtaccttaactaccttaccccgaaccggtaccgggaccctacgttcgtacctttaccgttacccgaaccgtaccggttacggtttaccaaggggttccggacgtaggggtttcgggttacgggtacggggtaaacgtaagggtttaccgtttaccctaccgtttacctacccgaaccctaagttacccgaacggtaccgtaccggtcccgtacgacgttacggttacgtaaaggtaaacgtttcttcggtaccttaaccttttaacgtttttaacttacggttcggttaccgaacggttaaccgttaacggttttaaactttaaaagggttacggggttacccggggttaccgggtttaacggggttaacccgggtttacccgggaaacccgggggttaaacggggtaaacccggttaagggggttaaacgggtaaaacccttaaacccgggtaaaaacccgggttaacggtttcggggttaaccgggtaccggttaccggaacccccttaaacgttacgtttccggtttacccgg

SEQ ID NO: 103536 - DNA, 171 bp, Homo sapiens
  misc_feature: GYAE6OF02FXXRH.34.34.D01.1.454.CMB.1.raw
  modified_base (171)..(171): a, c, t, g, unknown or other
  misc_feature (171)..(171): n is a, c, g, or t
tcagtacacgtgatcacgaccggtgctcgatttagatcgtctgtgttgggtttggggaagaggaagactgacggtccccaggagttcaggtgctgggcacagcggccctgggctgcctggtcaaggactacttccatcacgtgtactgagcgggctggcaaggcgcatagn

SEQ ID NO: 103537 - DNA, 259 bp, Homo sapiens
  misc_feature: GYAE6OF02H0NEN.34.34.D01.1.454.CMB.1.raw
  modified_base (253)..(259): a, c, t, g, unknown or other
  misc_feature (253)..(259): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttcccgccatctgaatcatgtgtactgagcgggctggcaaggcgcatagnnnnnnn

SEQ ID NO: 103538 - DNA, 553 bp, Homo sapiens
  misc_feature: GYAE6OF02IYZKM.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtgcagtggtctgggacagagttcactctcaccatcagcagcctgcagtctgaatattctgcttactttacttacttgtacagtactagtactaaagtaacgtcgggtaccgtgggtaacgttccggaccgaaggggtaccaaaggggttcggaaaagttccgaaaaccggtaacttgggtacggtacctggacccgtaactacgttcgttaccgg

SEQ ID NO: 103539 - DNA, 503 bp, Homo sapiens
  misc_feature: GYAE6OF02IDIIX.34.34.D01.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccacagggccatgctatccagccaggttcagtgcagtgggtctgggacagagttcactctcacatcagcagcctgcagtcngaagattcngctacttttatacctgtcagtcagtacttaataagtgccgtggaccgtttcgggaccagggaccaagggtaggaaatacaaacgaactggtacggctgacacagtctcg

SEQ ID NO: 103540 - DNA, 490 bp, Homo sapiens
  misc_feature: GYAE6OF02F98HU.34.34.D01.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
  modified_base (485)..(485): a, c, t, g, unknown or other
  misc_feature (485)..(485): n is a, c, g, or t
tcagtacacgtgatcacgaccggtgctcgatttagatcgtctgtgttgggtttggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagattcngcactttatactgtcagcagtctaataagtggccgtggacgttcggccaagggaccaaggtggaaatcaaacgactgtggctgcacntctcg

SEQ ID NO: 103541 - DNA, 502 bp, Homo sapiens
  misc_feature: GYAE6OF02H3YT2.34.34.D01.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccagttcagtggcagtgggtctgggacagagttcactctcacatcagcagcctgcagtctagaatnttctgctacttttattactgtcagcagtctaatagtgcgtggacgttcgcagggaccaagggtacggaaatacgaaacgtacgtggtacggtctgaccactatctacg

SEQ ID NO: 103542 - DNA, 253 bp, Homo sapiens
  misc_feature: GYAE6OF02GH82K.34.34.D01.1.454.CMB.1.raw
  modified_base (253)..(253): a, c, t, g, unknown or other
  misc_feature (253)..(253): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttcccgccatctgaatcacgtgtactgagcgggctggcaaggcgcatagn

SEQ ID NO: 103543 - DNA, 503 bp, Homo sapiens
  misc_feature: GYAE6OF02IRR2E.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtggcagtggtctgggacagagttcactctcaccatcagcagcctgcagtctagaagattctgctacttttattactgtcagtctagtactaattaagtggccgttggacgttcggaccaagggaccaagggtggaaatcaaacgactgtggctgaccactatctg

SEQ ID NO: 103544 - DNA, 493 bp, Homo sapiens
  misc_feature: GYAE6OF02FWRRH.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagattctgctactttattactgtcagcagtctaatagtgccgtggacgttcggccagggaccaaggtggaaatcgaaacgactgtcggctgcaccatctcg

SEQ ID NO: 103545 - DNA, 513 bp, Homo sapiens
  misc_feature: GYAE6OF02H65HH.34.34.D01.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagtnttctgctacttttatactgtcagctagtctaataagtgtccgtggtacgttcggaccaagggtaccaagggtggaaactcgaaaacgacttggacggtactgaccacctagtcttacg

SEQ ID NO: 103546 - DNA, 514 bp, Homo sapiens
  misc_feature: GYAE6OF02IHB0A.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaaaccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccaggccactgctatccagccaggttcagtgcagtggtctgggacagagttcactctcaccatcagcagcctgcagtctgaagtattctgctactttattactgtcagcagtctaagtaagtggccgtaggacgttcggacaagggaccaagggtaggaaataccgaaacgtaacgtgtaggctacggaccaccgatccgtagttcc

SEQ ID NO: 103547 - DNA, 253 bp, Homo sapiens
  misc_feature: GYAE6OF02IOEAP.34.34.D01.1.454.CMB.1.raw
  modified_base (251)..(253): a, c, t, g, unknown or other
  misc_feature (251)..(253): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttccgcatctgaatcacgtgtactgagcgggctggcaaggcgcatagnnn

SEQ ID NO: 103548 - DNA, 498 bp, Homo sapiens
  misc_feature: GYAE6OF02HSZT0.34.34.D01.1.454.CMB.1.raw
  modified_base (203)..(203): a, c, t, g, unknown or other
  misc_feature (203)..(203): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctagaagtattctgctacttttattactgtcagtcagtactaatagtgccgtgacgttcggaccagggtaccaagggtggaaatcgaaacgactgnggctgcacntctcg

SEQ ID NO: 103549 - DNA, 485 bp, Homo sapiens
  misc_feature: GYAE6OF02G8IWA.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagngccaccctctcctgcagggccagtcagagtgttggcagcaacttagcctggtaccagcagaaacctggccaggctcccagagtcctcatctatgctacatccaccagggccactgctatccagccaggttcagtgcagtggtctgggacagagttcactctcaccatcagcagcctgcagtctgaagattctgctactttattactgtcagcagtctaatagtgtcgtgacgttcgcgaggaccaggtgaatcgaaacgtactgtcggctgacacatctcg

SEQ ID NO: 103550 - DNA, 254 bp, Homo sapiens
  misc_feature: GYAE6OF02IS75I.34.34.D01.1.454.CMB.1.raw
  modified_base (252)..(254): a, c, t, g, unknown or other
  misc_feature (252)..(254): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttcccgccatctgaatcacgtgtactgagcggctggcaaggcgcatagnnn

SEQ ID NO: 103551 - DNA, 516 bp, Homo sapiens
  misc_feature: GYAE6OF02H5CBS.34.34.D01.1.454.CMB.1.raw
  modified_base (393)..(393): a, c, t, g, unknown or other
  misc_feature (393)..(393): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctccagagtcctcatctatgctacatccaccaggccactgctatccagccaggttcagtggcaggtggtctgggacagtagttcactctcaccatcagcagcctgcagtctgaagnttctgactacttttatactgtcagtcagtactaatagtgccgtggacgttcggaccacgggactaagggtggaaacgttcgaaacgtaacgtggtcggtacgtagaccgtactactcgttacg

SEQ ID NO: 103552 - DNA, 546 bp, Homo sapiens
  misc_feature: GYAE6OF02GD1TG.34.34.D01.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagacgtcctcatctatgctacatccaccagggacactgctattccagccaggttcagtgcagtgggtctgggacagagttcactctcaccatcagcagcctgcagtctagaagtnttctgtctacttttatacttgtcagctagtactaagtagtcggccgttggaccgttcgggaccgaaggggacctaaggggtacggaaacttaccgaaaaccggtacgttaggtacggacttacggacctaacccgtagttccgttacgg

SEQ ID NO: 103553 - DNA, 498 bp, Homo sapiens
  misc_feature: GYAE6OF02H0T8X.34.34.D01.1.454.CMB.1.raw
  modified_base (203)..(203): a, c, t, g, unknown or other
  misc_feature (203)..(203): n is a, c, g, or t
  modified_base (495)..(495): a, c, t, g, unknown or other
  misc_feature (495)..(495): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctatccagccaggttcagtgcagtggtctgggacagagttcactctcacatcagcagcctgcagtctgaagtattctagctacttttatactgtcagctagtctaagtagtgccgtggtacgttcgaccgaaggacaaggtggaaatacaaacgtactgtacggctagccacgatntcg

SEQ ID NO: 103554 - DNA, 256 bp, Homo sapiens
  misc_feature: GYAE6OF02HI82Y.34.34.D01.1.454.CMB.1.raw
  modified_base (245)..(245): a, c, t, g, unknown or other
  misc_feature (245)..(245): n is a, c, g, or t
  modified_base (251)..(256): a, c, t, g, unknown or other
  misc_feature (251)..(256): n is a, c, g, or t
tcagtacacgtgatcacgaccggtgctcgatttagatcgtctgtgttgggtctgggacaggagttcactctcaccatcagcagcctgcagtctgaagattctgcactttattactgtcagcagtctaataagtggccgtggacgttcggccaagggaccaaggtggaaatcaaacgactgtggctgcaccagtctgtcttcatcttccgcatctgaatcacgtgtactgagcggctggcaaggcncatagnnnnnn

SEQ ID NO: 103555 - DNA, 551 bp, Homo sapiens
  misc_feature: GYAE6OF02IYXG4.34.34.D01.1.454.CMB.1.raw
  modified_base (303)..(303): a, c, t, g, unknown or other
  misc_feature (303)..(303): n is a, c, g, or t
tcagtacacgtgatcacgaccggtgctcgatttagatcgtctgtgttgggtttgggggaggaactgctcagttaggacccagacggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggngcgtccaccagggccactggcatcccagacaggttcagtggcaggtgggtctgggacagacttcactctcaccatcagcagacttgacgcctagaagtattttgactagttatattactgtacagtactaatatacgagacgacacgtgtcgggtcgttcggaccgtaacgggaccgaagggtaggaacgtacgaaacggaacgtagtcggacgtcgacgaccgtacgtctcgtcttactacttcccg

SEQ ID NO: 103556 - DNA, 517 bp, Homo sapiens
  misc_feature: GYAE6OF02G15G2.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttagcggctacttagcctggtaccagcagaaacctggccaggctcccaggctcctcatctatgatgcgtccaacagggccactggcatccccagccaggttcagtggcaggtgggtctgggccagcttcactctcaccatcagcagcctagacgacctaaagtattttagactaatttattactgtcagtctgcgtagcaactggccttcccttgacgtccgccgttcggccgagggacacggacgtggagattaaacgacttggtcggctgaccactatcg

SEQ ID NO: 103557 - DNA, 517 bp, Homo sapiens
  misc_feature: GYAE6OF02JSK4O.34.34.D01.1.454.CMB.1.raw
  modified_base (231)..(231): a, c, t, g, unknown or other
  misc_feature (231)..(231): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagtacacgtgatcacgaccggtgctcgattagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcgagggccagtcnggagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtcngaagnttctgctactttatactgtacagcagtctaagtagtggccgtggaccgttcggacctagggaccaagggtacggaaagtacgaaacgtaacgtaggtacggtactagaccaccatctacg

SEQ ID NO: 103558 - DNA, 486 bp, Homo sapiens
  misc_feature: GYAE6OF02GI34L.34.34.D01.1.454.CMB.1.raw
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (482)..(482): a, c, t, g, unknown or other
  misc_feature (482)..(482): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtggcaggtggtctgggacagagttcactctcaccatcagcagcctgcagtctgaagattcngctactttatactgtacngcagtctaatagtgctggacgttcgcagggccaagggtgaaatcaaacgctaggcggctgcaccntctg

SEQ ID NO: 103559 - DNA, 493 bp, Homo sapiens
  misc_feature: GYAE6OF02GK23U.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctcccagagtcctcatctatgctacatccaccagggccactgctatccagccaggttcagtggcagtgggtctgggacagagttcactctcaccatcagcagcctgcagtctgaagattctgctatttatactgtcagcagtctaatagtgccgtggacgttcggccagggaccaagggtcgaaatcgaaacgactggacggctgacactatcgtcg

SEQ ID NO: 103560 - DNA, 498 bp, Homo sapiens
  misc_feature: GYAE6OF02FQVWV.34.34.D01.1.454.CMB.1.raw
  modified_base (399)..(399): a, c, t, g, unknown or other
  misc_feature (399)..(399): n is a, c, g, or t
  modified_base (495)..(495): a, c, t, g, unknown or other
  misc_feature (495)..(495): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctatccagccaggttcagtggcagtgggtctgggacagagttcactctcaccatcagcagcctgcagtctgaagtattcngctactttatactgtcagcagtctaatagtgccgtggacgttcggaccagggaccaagggtgaaatacgaaacgactaggtcggctacgcactatntcg

SEQ ID NO: 103561 - DNA, 496 bp, Homo sapiens
  misc_feature: GYAE6OF02HPJ9Q.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctgaagtattttgctagtgtattattgtcagcagcatcatcggtcaccgtacacgtttgccgagggaccaagctggagatacaaacgaactgtggctgcacctac

SEQ ID NO: 103562 - DNA, 494 bp, Homo sapiens
  misc_feature: GYAE6OF02GPEON.34.34.D01.1.454.CMB.1.raw
  modified_base (397)..(397): a, c, t, g, unknown or other
  misc_feature (397)..(397): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctattccagccaggttcagtgcagtggtctgggacagagttcactctcaccatcagcagcctgcagtctgaagattcngctactttattactgtcagctagtctaatagtgccgtggacgttcgaccagggaccaaggtggaaatcgaaacgactggtaggctgacactatctcg

SEQ ID NO: 103563 - DNA, 487 bp, Homo sapiens
  misc_feature: GYAE6OF02HKWY0.34.34.D01.1.454.CMB.1.raw
  modified_base (394)..(394): a, c, t, g, unknown or other
  misc_feature (394)..(394): n is a, c, g, or t
  modified_base (475)..(475): a, c, t, g, unknown or other
  misc_feature (475)..(475): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagacgtcctcatctatgctacatccaccagggccactgctatccagccaggttcagtgcagtggtctgggacagagttcactctcacatcagcagcctgcagtctagaagtnttctgactactttatactgtcagcagtctaatagtgccgtgacgttcgacagggaccaagggtgaaatcgaaacgactggngctgcacatctg

SEQ ID NO: 103564 - DNA, 517 bp, Homo sapiens
  misc_feature: GYAE6OF02HVCSP.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccaccagggccactgctatccagccaggttcagtggcagtgggtctgggacagagttcactctcaccatcagcagcctgcagtctagaagattctgctacttttatactgtcagctagtctaataagtggccgttggacgttcggaccgaagggaccaagggtggaaactacgaaaacggtaacgtggtacggctcgaccacctagtcttacg

SEQ ID NO: 103565 - DNA, 559 bp, Homo sapiens
  misc_feature: GYAE6OF02IMOVF.34.34.D01.1.454.CMB.1.raw
  modified_base (204)..(204): a, c, t, g, unknown or other
  misc_feature (204)..(204): n is a, c, g, or t
  modified_base (391)..(391): a, c, t, g, unknown or other
  misc_feature (391)..(391): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaattgcctggtaccagcagaaacctggaccaggctcccagacgtcctcatctatgctacatccacagggccactgctatccagccaggttcagtgcagtggctgggacagatcactctcaccatcagcagcctgcagtctagaagtnttctgctacttttattactgtacagtccagttactaaagttacggtggtcccggtaggttacccggttccgggaccgtaacgggggaccctaaaggggtcggtaaaacgtaccgaaaaccggtaaccgtaggttacgggacttcggacctaacccgtattccgttacg

SEQ ID NO: 103566 - DNA, 536 bp, Homo sapiens
  misc_feature: GYAE6OF02IP4HA.34.34.D01.1.454.CMB.1.raw
  modified_base (203)..(203): a, c, t, g, unknown or other
  misc_feature (203)..(203): n is a, c, g, or t
  modified_base (412)..(412): a, c, t, g, unknown or other
  misc_feature (412)..(412): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaangccaccctctcctgcagggccagtcagagtgttggcagcaacttgcctggtaccagcagaaacctggccaggcctcccagacgtcctcatctatgactacactccaccagggccactgctattccagcctaggttcagtggcaggtcgggtctgggacagagttcacttcgtcacctatcacgcacgcctgcagtctagaagtattcgngtcttactttattactgtcagcctagtactaagttaggtcggaccgttggtacgttccggacgtacgggaccgaagggtagaaactacggaaacgtacgtaggtcggcgtgacacctatcgtcg

SEQ ID NO: 103567 - DNA, 546 bp, Homo sapiens
  misc_feature: GYAE6OF02GQ051.34.34.D01.1.454.CMB.1.raw
  modified_base (203)..(203): a, c, t, g, unknown or other
  misc_feature (203)..(203): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaacctggccaggctcccaggcctcctcatctatggtgcatccaccgagggccactggtactcccagccaggttcagtgcagtgggtcngggacagattcactctcacntcagcagcctgctagtctagaagtatttgactagtttattactgtcagctagtaataatacgtcggtaccgtcggggtacgttcggaccgaagggaccgtaagggttcgtaacgttacgaaaccggtacgttggtacggccgtacgccgtaaccgtattcgttcgttacttaccg

SEQ ID NO: 103568 - DNA, 524 bp, Homo sapiens
  misc_feature: GYAE6OF02IWVK4.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagcccaccctctcctgcagggccagtcagagtgttggcagcaacttagcctggtaccagcagaaacctggccaggcctcccagagtcctcatcctatgctacatccaccagggccactgctatccagccaggttcagtggcaggtggtctgggacagagttcactctcaccatcagcagcctgcagtctaggaacgtattctgctactttattactgtacagctagtactaataacggtcgtcgtggtacgttcggacagggaccaagggtggtaaactacgaaaacgtaccgtaggtacggtctcggaccactatctacg

SEQ ID NO: 103569 - DNA, 493 bp, Homo sapiens
  misc_feature: GYAE6OF02JDCNX.34.34.D01.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctcccagagtcctcatctatgctacatccaccagggccactgctatccagccaggttcagtggcagtggtctgggacagagttcactctcaccatcagcagcctgcagtctagaagnttctgctactttattactgtcagcagtctaatagtgcgtggacgttcgccgagggaccaagggtggaactacgaaacgactgacggctgccactatctcg

SEQ ID NO: 103570 - DNA, 539 bp, Homo sapiens
  misc_feature: GYAE6OF02HB05V.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccaggccactgctatccagccaggttcagtgcagtggtctgggacagacttcactctcacatcacagactggagcctagaagtattttgactagttgttacttacgtgtactaactagttcggtacctacactacgtacggtcggtaccggttcggaccgaagggtaccgaagggtaggaaacgtacgaaacgtaacgtgtacggacgtacgccaccgtatctagtcttacg

SEQ ID NO: 103571 - DNA, 541 bp, Homo sapiens
  misc_feature: GYAE6OF02HF869.34.34.D01.1.454.CMB.1.raw
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactcncacatcagcagcctgcagtctgaanattctgactatttattactgtcagtcagtctaaagtagtggtccgtggtaccgttcgggaccgaggggtacctaaggggtcggaaattaccgaaaaccgtaacgtggttacgggaccttaggaccctaaccgtacgttccgttacgg

SEQ ID NO: 103572 - DNA, 657 bp, Homo sapiens
  misc_feature: GYAE6OF02JE8YQ.34.34.D01.1.454.CMB.1.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtgtctaccgaggggaaancgccaccctctcctgcagggccagtcagagtgtggcgctactgcctggtaccagcagaacctggccaggctccaggcctccncatctatgatgccgtcaacgnggccagtcggcactccccagcctaggttcagtcgcgtaggtgggtctcgggcctagtcttcgacctcctccactacgtacacgtcgacgacccgtaagaccgtaaccttaaaggttactttacgaacctttaaagtttactttacgtacgtaccgtacgtcgttacggtaccgtaacgtacctaaccggttccggttaccccgttaccgttacgggtaacccgtcccggttacccgggttacccgggacccgggtaccgggtaacccaaccgggtaccgtaagggtaaccgttaaacgttaaaccggtagttccggtaggtaccgtacgacccttaccgtgttaccgg

SEQ ID NO: 103573 - DNA, 510 bp, Homo sapiens
  misc_feature: GYAE6OF02I85Y8.34.34.D01.1.454.CMB.1.raw
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagccctggtaccagcagaaacctggccaggcctcccagagtccctcatctatgctacatccaccagggccactgctatccagccaggttcagtggcagtggtcngggacagagttcactctcaccatcagcagccctgcagtcagaatnttctgctactttattactgtcagtctagtctaaatagtggccgtggacgttcgcgagggactaagggtggaaactccgaaaaggtactaggtcgacgtcgacacagttctacg

SEQ ID NO: 103574 - DNA, 753 bp, Homo sapiens
  misc_feature: GYAE6OF02IHOSA.34.34.D01.1.454.CMB.1.raw
  modified_base (307)..(307): a, c, t, g, unknown or other
  misc_feature (307)..(307): n is a, c, g, or t
tcagtacacgtgatcacgaccggtgctcgatttagatcgtctgtgttggggtttgggggaggaactgctcagttaggacccagacggaaccatggaagccccagcgcagcttctcttccctccgtgctactctggcctccagacaccactggacgaaatagtgatgacgcagtctccacgccaccctgtctgtcgtctaccgaggggaaacgcgccaccctctacctgcagggccagtcagagtgttcggcagcaacttagcctagtaccagcaagaaacctggaccaggcctcccagacgtcctanactacgtactgacctaacactaccaccgagggacctacgtcgtactacttaccacggtccgtaggttaccaggttcggacgtaggttcgggtcgtaggggacaaggtaacggttcaacttcgtaccaaccttataccgaacgcaaacggtccctaggaccgtaacggtacctaagggtaaactcgtttacgacgttaccttaactttttaacgttaactcggttaccgtaaaggtacccttaagttacttaaacgttaaacgggtccgggttacccgggttaggttaaccgggttttaccgggtaacccggtttaaacgggggaacccgtttaaagggggtaaccggtaaaaacgtaaacccggttaaaacggttaaccgttaagggttaccccggttacgttaaccgggaccccggttaaccgttacgtttaccgtttaacccgg

SEQ ID NO: 103575 - DNA, 177 bp, Homo sapiens
  misc_feature: GYAE6OF02GP1YN.34.34.D01.1.454.CMB.1.raw
  modified_base (171)..(177): a, c, t, g, unknown or other
  misc_feature (171)..(177): n is a, c, g, or t
tcagtacacgtgatcacgaccggtgctcgatttagatcgtctgtgttgggtttgggggaagaggaagactgacggtcccccaggagttcaggtgctgggcacagcggccctgggctgcctggtcaaggctacttccatcacgtgtactgagcggctggcaaggcgcatagnnnnnnn

SEQ ID NO: 103576 - DNA, 670 bp, Homo sapiens
  misc_feature: GYAE6OF02I149A.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagngccacctctcctgcagggccagtcaggagtgttggcagcaacttgcctggtaccagcagaaacctggccaggcctccagagtcctcatctatgctacactccaccgaggccactgctatccagcctaggtcagtggcaggtgggtctgggactaggtacgttaccacgttctacacctagtaccagcacgccttggaccaggttcctagggaaacgttactttcgtacgtaccttaacgtttttaacttaccgtcgttaccaaggtcctaaggtttaccttaaagttaacgggttcgggtacccggtttacggggttaaaccggtttccggggaacccgtaaaggggggtaacccgtaaacgggggtttacgggaaaaaccgttaccggtaaaaaccggtaccgtttaggggtaccgggtaccgttacgggtaaccctaacccgttacggttaccgtttaccggg

SEQ ID NO: 103577 - DNA, 486 bp, Homo sapiens
  misc_feature: GYAE6OF02F7OU3.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtgcagtgggtctgggacagagttcactctcaccatcagcagcctgcagtctgaagattctgctactttatactgtcagcagtctaatagtgccgtggacgttcgcaggccaaggtgaatacgaaacgactgtcggctgcaccatctcg

SEQ ID NO: 103578 - DNA, 615 bp, Homo sapiens
  misc_feature: GYAE6OF02GT28M.34.34.D01.1.454.CMB.1.raw
  modified_base (204)..(204): a, c, t, g, unknown or other
  misc_feature (204)..(204): n is a, c, g, or t
  modified_base (335)..(335): a, c, t, g, unknown or other
  misc_feature (335)..(335): n is a, c, g, or t
  modified_base (391)..(391): a, c, t, g, unknown or other
  misc_feature (391)..(391): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgtggcagcaacttgcctggaccagcagaacctggccaggctccagacgtcctcatctatgctacatccaccgagggccactgctatccagcctaggttanggcagtgggtctgggacgagtagttcactctcaccactacagacacgccgtgacgngtctagtaagtacttcgttagcgtaacttttacttactcgtagtacgacgtacgttacgttaaacgttaaggttcggggtaccggttacgggtaccggtttaccgggaccggaaaccgggacggtaaaccgggtaagggtaaacctaaaccgtaaaaccgggaaacgttcgggttagggtaccgtacggtacccaacccggtaacttacgtttaccgttacccg

SEQ ID NO: 103579 - DNA, 520 bp, Homo sapiens
  misc_feature: GYAE6OF02IIIJF.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaacctggccaggctcccagagtcctcatctatgctacatccaccagggccactgcttattccagccaggttcagtggcaggtgggtctgggacagagttcactctcaccatcagcagcctgcagtctagaagtacttctgctacttttattactgtcagcagtactaagtagtcgccgtggaccgttcggaccgaagggacctaagggtaggaaactcgaaacgtaacgtggtggacgtagaccacctatcgtacg

SEQ ID NO: 103580 - DNA, 631 bp, Homo sapiens
  misc_feature: GYAE6OF02GMU8U.34.34.D01.1.454.CMB.1.raw
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (398)..(398): a, c, t, g, unknown or other
  misc_feature (398)..(398): n is a, c, g, or t
tcagtacacgtgatcacgaccggtgctcgatttagatcgtctgtgttgggtttgggggaggaactgctcagttaggacccagacggaaccatggaagcccccagcgcagcttctcttcctcctgctactctggctcccagacaccacgtggaggaaatagtgatgtacgcagtctcctagccaccctgtctgtgtctccgaggggaaagngccaccctctccgtgcagggccagtccaggagtcgttggcagcaacttgcctggtaccngcagaaacctggccaggctcccagcgtcctcatctatcgcctacatcccaccgaggggcccactgactattccagccctaggtttcagtggcaggtggtcgtacgggacaggacgttcacgtctcaccngtcgagcacgccttgctacgtctagaatatttcgagtacctacttttacttaaccgttcgtacctagtacctagttaccttaaagtaacggttcggtaccggtagggtaacccgtttccgggacccggtaacggggtaacccgtaacggggttaacgggaaaacttaccggaaaaccgtaacccgttagggtacgggtaccgtcggaaccctaaccgtacgttcgtttaccgg

SEQ ID NO: 103581 - DNA, 493 bp, Homo sapiens
  misc_feature: GYAE6OF02GO8AV.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgagattctgctactttattactgtcagtcagtctaataagtgccgtggacgttcggaccagggaccaaggtggaaatcgaaacgactgtggctgcacatctcg

SEQ ID NO: 103582 - DNA, 703 bp, Homo sapiens
  misc_feature: GYAE6OF02JOG3T.34.34.D01.1.454.CMB.1.raw
  modified_base (291)..(291): a, c, t, g, unknown or other
  misc_feature (291)..(291): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaacttagcctggtaccagcagaacctgccaggctccagagtccctanatctatcgctacactccaccgaggcccactgcttatccgagcctaggttcaacggtggccaggttggggtactcggggaactaggtacgtttccgaacttcgtaccaccgagttccgaacgtccaaggtccctagtacgtacgttacgtaggtaaacgttctttactacggtaccttaacgttttattaaccgtcggtttaactacggtaccttaacgttccgtttaaaacgttaacgggtccggggtacccgtttacgggggaaccgggttttacccggaaacccgggtaacgggtaacccggtaaaggggttcgggtaaaaaacctttaccgggaaaaacccgtaacgggtttcggttacggggaaccgtttccggacccgtaaacccggtaagttcccggtttaaccgg

SEQ ID NO: 103583 - DNA, 252 bp, Homo sapiens
  misc_feature: GYAE6OF02GZQU8.34.34.D01.1.454.CMB.1.raw
  modified_base (252)..(252): a, c, t, g, unknown or other
  misc_feature (252)..(252): n is a, c, g, or t
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttcccgccatctgaatcacgtgtactgagcggctggcaaggcgcatagn

SEQ ID NO: 103584 - DNA, 661 bp, Homo sapiens
  misc_feature: GYAE6OF02GH1AB.34.34.D01.1.454.CMB.1.raw
  modified_base (213)..(213): a, c, t, g, unknown or other
  misc_feature (213)..(213): n is a, c, g, or t
tcagtacacgtgatcacgaccggtgctcgatttagatcgtctgtggttaggggtttgggggaggaactgctcagttaggacccagacggaaccatggaacgccccagcgcagcttctcttcctcctgctactctggcctcccagacaccactggaagaaatagtgatgacgcagtctccagcccaccctgtctgtcgtctccgaggggaaagngccaccctctcctgcgacgggccagtcagagtgttggcagcaacttcgccgtggtaccagcaagaacctggaccaggcctcccgagacgtcctcatctatcgctacactccgaccgacgggcctacgtcgaccttacgttccgacgtccgtacggttcaggtcggcgtagggtcgggtcgtagggactaggtacgttccacttcctaccgaacctagtacgaacgtcgacgtccgtaggcctaacggttctaggtaacgtctttacgtacgttaccttacttttaacgttaccttgtacgtagtaccgtagttaccgttaagttacgggttcggacccggttggtaaccgttccgggaaccgtaagggaccctaaggggttacggaaacttaccggaaaacgttaccggttaggtaccggacttacggacctaccgtagtcgttaccg

SEQ ID NO: 103585 - DNA, 526 bp, Homo sapiens
  misc_feature: GYAE6OF02G6S1T.34.34.D01.1.454.CMB.1.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctcccagacgtcctcatctatgctacatccaccagggccactgctatccagccaggttcagtgcagtggtctgggacagngttcactcncaccatcagcagcctgcagtctgaagtnttcgtgtctactttatactgtcagtcagtactaatagttcggcgtaggacgttcggacctagggaccgtaagggtcggaaactaccgaaaacggtacgttaggtacggtcctagacctaaccgtagtcgttacg

SEQ ID NO: 103586 - DNA, 540 bp, Homo sapiens
  misc_feature: GYAE6OF02HCQXJ.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgttggcagcaacttagcctggtaccagcagaaacctggccaggcctcccagacgtcctcatctatgctacatccaccgagggccactgctacttccagccaggttcagtggcaggtggtctgggacagtacttcactctcaccatcagcacgcctgctagtctagaagtattctgcttactttattactgtcagtctagtactaaagtaacgtcggaccgtggtaccgttcgaccgtaagggaccgtaagggtacggaaatacgaaacgtacgttggtacggtactaggaccaccgattccgttcg

SEQ ID NO: 103587 - DNA, 586 bp, Homo sapiens
  misc_feature: GYAE6OF02JK6AM.34.34.D01.1.454.CMB.1.raw
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (443)..(443): a, c, t, g, unknown or other
  misc_feature (443)..(443): n is a, c, g, or t
tcagtacacgtgatcacgaccggtgctcgatttagatcgtctgtgttggttttgggggtaggaacgtgctcagttaggacccagacggaaccatggaagccccagcgcagcttctcttcctcctgctactctggctcccagacaccactggagaaatagtgatgacgcagtctccagccaccctgtctgtgtctaccgaggggaaagcgcccaccctctccgtgaccgaggggcccaaggtccaggaggttgttggccaggccaactttagcctggtaccagcagaaacctggccaggcctcccgagacgtccctnatctatgctacntccacgnggccatgcttatccagccaggttcaggtcggactagggtgggtctgggaacaggtacttccgacgttcctacaccgactcaggcacggcctggcacgtctagaacgtnttctgtactacgtttattactgttcagtactagtactaaagtacgtcgtcggtacggacgttcgaaccgacgggtaccgaagggtacggaaacttaccgaaacgtaacgtacggtcggtactacggacctacgtatccgttcg

SEQ ID NO: 103588 - DNA, 620 bp, Homo sapiens
  misc_feature: GYAE6OF02FUDMN.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaagagccaccctctcctgcagggccagtcagagtgttggcagcaacttagcctggtaccagcaagaaacctggccaggctcccagacgtcctcatctatgctacactccaccaggccactgctattccagccaggttcagtcggctaggtgggtcgtagggacaggagtttccacgttctacaccatcgagcgacgtccctgcctagtcctaggaacgtacttcgtgcttaacttttacttactgtcgtagtctaagtaccttaaagttaacggtcgggtaccgttacgggtaccgtttaccgggaccggtaaacggggtaccgtaaacgggggttacggtaaaaacttaccggaaaaacggttaaccggttaggttacgggtaccgttacggacccgtaaccgtacgttacccgttacgg

SEQ ID NO: 103589 - DNA, 1014 bp, Homo sapiens
  misc_feature: GYAE6OF02HXM3G.34.34.D01.1.454.CMB.1.raw
tcagtacacgtgatcacgaccggtgctcgatttagatcgtctgtggttaggggtttagggggacggaactgactaccagttaggacccgagacggaaccatggaagccccagcgcagcttctccttcctcctgctactctggctcccagtacacccactggacgaaatagttgatgacgcagtctaccagccacctgtctgtgtctccgagggaacagccacctctcctgccggagggccagtcagagtgttggcagcaacttagcctggtaccagcacgaaacctggcctaaggcctacccgagtacggtccctacacttcctaacgtcggacctaacgacttccccaacccgacggggcccctaaccgttcggtacctttaacgtttaccccgaacggtaccccgttaaagggttttccaacgggtttccgggtaccgtttacggggtttcggggggttacccgttaggggggtaaaccctaacggggttaccggtttttacccgtaacccgtttcccggtttaacccctaaccccgttaacgtttaccccggaaaccgggtaaccccgtaaacgggtcccccgtttacgggtaccccgttaaccgggttacccgttaacggggtaaaaccggttaccgggttttaccccgttaacgggtaaccctttaaacccgtttttttaaacgttttaacccggtttagggtttaacccgtaaacggtttacccggttaaacggttttaaccgttttaaaaacggtttaaaccggggtttccgggggttaaccccggggttttaacggggttaaacccgggtttttacccgggggtaaaccccgggttaaaccgggggggttaaaccccgggttaaagggggggttttaaccggggtttaaaaaccggttttaacccgggtaaaaaacccgggtttaaccgggtttacgggggttaacgggtacccggttaacgggacccccgttaacccggttaaccgtttccccggtttaacccgg

SEQ ID NO: 103590 - DNA, 513 bp, Homo sapiens
  misc_feature: GYAE6OF02FSFSJ.34.34.D01.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagacgtcctcatctatgctacatccaccagggccactgctatccagccaggtcagtgcaggtgggtctgggacagagttcactctcaccatcagcagtcctgcagtctagaagtnttcngtctatttactactgtcagcagttactaatacgtggtccgtggacgttcggacctaagggacctaagggtcgaaatacgaaaacgtagtgtacggctagacacctagtctcg

SEQ ID NO: 103591 - DNA, 501 bp, Homo sapiens
  misc_feature: GYAE6OF02HG3AB.34.34.D01.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangcccaccctctcctgcagggccagtcagagtgttggcagcaacttagcctggtaccagcagaaacctggccaggctccagagtcctcatctatgctacatccaccagggccactgctattccagccaggttcagtgcagtggtctgggacagngttcactctcaccatcagcagcctgcagtctagaagtattctgctactttattactgtcagctagtactaataagtggccgtggacgttcgaccgagggaccaagggtggaaatacaaacgacgtgtacggctgacactatctcg

SEQ ID NO: 103592 - DNA, 487 bp, Homo sapiens
  misc_feature: GYAE6OF02IAJWB.34.34.D01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctnatctatgctacatccacagggccactgctatccagccagttcagtggcagtgggtctgggacagagttcactctcacatcagcagcctgcagtctgaagtnttctgctactttattactgtcagcagtctaatagtgcgtggacgttcgcaagggacctaagggtnaatcgaacgtaatgtgctgacactatntcg

SEQ ID NO: 103593 - DNA, 550 bp, Homo sapiens
  misc_feature: GYAE6OF02HRPPL.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaagagccaccctctcctgcagggccagtcagagtgttggcagcaacttagcctggtaccagcagaacctggaccaggctcccagacgtcctcatctatcgctacatccaccgagggccactgctatccagccagtcagtggcaggtggtctgggactaggtagttcactctccaccatacgagcacgcctagcagtctagaatacttactgacttactttattactgtacacgtactagtactaaagtaggttcgccgtaggtaccgttcggaccgtaacggggaccgtaaggggtcgtaaactcgaaaaccgtacgtggtacggacttgacctaaccgtattcgttacg

SEQ ID NO: 103594 - DNA, 599 bp, Homo sapiens
  misc_feature: GYAE6OF02JFCU0.34.34.D01.1.454.CMB.1.raw
  modified_base (351)..(351): a, c, t, g, unknown or other
  misc_feature (351)..(351): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaacctggccaggctcccaggctcctcatctatggtgcatccaccagggccacgtggtactcccagccaggttcagtgcagtgggtcnggggacagaattcactctcacatcacgtcagccctgccagtctagaagtattttggactagtttacttactgttcagtctagttaataacgtaacgtcgggtccgttcccgggggtaaccgttccggacccggtaaacggggtacccgtaaggggttaggtaacgtttaaccggtaaaaccggtaacgttcggtacggtaccgttacggtaccgaacccgtatttccggttacgtttacctttacccg

SEQ ID NO: 103595 - DNA, 704 bp, Homo sapiens
  misc_feature: GYAE6OF02ISLFV.34.34.D01.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagtacacgtgatcacgaccggtgctcgatttagatcgtctgtgttgggtttgggggaggaactgctcagttacggacccagacgggaaccatggaagccccagcgcagcttctcttcctcctgctactctggctccagacaccgactggagaaatagtgatgacgcagtctccagccacctgtctgtcgtctcgaggggaaancgccacctctcctgacagggccagtccagngtgtggcagcaacttgcctggtaccagcaagtaaacctggaccaggcctcccgagacgtcctacactctatgtacctaacactcccaaccgacgggacccaacgttgaccttaacgttcccacgacccgtaaggtttcgaacggttcggccgtaagggtcgggttacgtaggggaccaaggtcgtttacacctctacccgaacaactcgaacgacgacgcccgttggaccaggttccaaggtaaacgttcgtttcctaggtacctttaaacctttttagttaccgttacgggtacacggacttaacgtaaccgttaaagtaacgggtcgggtacccggttagggtaaccgttaccggaacggtaacgggtaacccgtaaagggttaaccggtaaagttaacccgaaaacggttaacggttaggttacgggtacttaacggacccgtaaccgttacgtaaccgttttcgg

SEQ ID NO: 103596 - DNA, 556 bp, Homo sapiens
  misc_feature: GYAE6OF02IR99M.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaanagccaccctctcctgcagggccagtcagagtgttggcagcaacttagcctggtaccagcagaaacctggccaggctccagacgtcctcatctatgctacatccaccgagggccactgctattccagcctaggttcaggtggctaggtgggtcgtagggacagacgttcactctacacatcagcagcctgctagtctagaagtacttcgtagaccttaacttttacttactcggtacagtactaggttactaaagttacggtcgggtccgtagggtaacgttccggaccgaacgggaccgtaagggtacgaaactacgaaacgtacgtaggtacggcgtgacctacctagtctag

SEQ ID NO: 103597 - DNA, 567 bp, Homo sapiens
  misc_feature: GYAE6OF02IMWRP.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaacctggccaggctcccaggcctcctcatctatggtgcatccaccgagggccactggtactcccagccaggttcagtcggcaggtgggtctgggacagtaacttcactctacaccatcagcagcctgcagtcagtagtatttcgattagtttattactgtacagtctaagttaataaacgtacgtacggtcccgttacccggggtacggtttaccggaccgaacggggtacctaagggttacgaacgttaacgaaaccgtaacgtggtacggacgtcgactaccgtaatcgttcgtcttaccg

SEQ ID NO: 103598 - DNA, 507 bp, Homo sapiens
  misc_feature: GYAE6OF02GBLOD.34.34.D01.1.454.CMB.1.raw
  modified_base (202)..(202): a, c, t, g, unknown or other
  misc_feature (202)..(202): n is a, c, g, or t
  modified_base (391)..(391): a, c, t, g, unknown or other
  misc_feature (391)..(391): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccaggggaaanagccaccctctcctgcagggccagtcagagtgttggcagcaacttgcctggtaccagcagaaacctggccaggctcccagagtcctcatctatgctacatccaccagggccactgctattccagccaggttcagtggcagtggtctgggacagagttcactctcaccatcagcagcctgcagtctgaanttctgctactttatactgtcagctagtctaagtagtggccgtggtacgttcggacctagggaccaagggtaggaaacttcgaaacgtaacttggtacggctagccacgtatcgtcg

SEQ ID NO: 103599 - DNA, 561 bp, Homo sapiens
  misc_feature: GYAE6OF02F8OLT.34.34.D01.1.454.CMB.1.raw
  modified_base (204)..(204): a, c, t, g, unknown or other
  misc_feature (204)..(204): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (550)..(550): a, c, t, g, unknown or other
  misc_feature (550)..(550): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccctctcctgcagggccagtcagagtgttggcagcaacttagcctggtaccagcagaaacctggccaggctcccagcgtcctcatctatgctacatccaccagggccatgactatccagccaggttcagtgcagtgggtctggacagngttcactcncacntcagcacgctgctagtctacgaagtacttcgtgacttaactttattactgtcagactagttactaaagttacgttcgggccgttaggtaccggttacgggaccctaggggtaccgtaaagggttcgggaaaacttaccggaaaaccgtaacgttcggtacgggccttaggacccaaccgtnttaccgttacg

SEQ ID NO: 103600 - DNA, 489 bp, Homo sapiens
  misc_feature: GYAE6OF02HSQW7.34.34.D01.1.454.CMB.1.raw
  modified_base (394)..(394): a, c, t, g, unknown or other
  misc_feature (394)..(394): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaagagccaccctctcctgcagggccagtcagagtgttggcagcaacttagcctggtaccagcagaacctggccaggctcccagacgtcctcatctatgctacatccaccaggccactgctattccagtcaggttcagtggcaggtggtctgggacagagttcactctcaccatcagcagcctgcagtctagaatnttctgcttactttatactgtcagctagtctaatagtgtccgtggacgttcgcgagggacctaagggtgaaatcaaagactgtgctgcactatctg

SEQ ID NO: 103601 - DNA, 528 bp, Homo sapiens
  misc_feature: GYAE6OF02I3896.34.34.D01.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcagaaacctggccaggctcccagagtcctcatctttggngcgtccaccagggccactggcatcccagacnggttcagtgcagtggtctgggacagctcactctcaccatcagcagacttgacgcctgaagtatttgactagtatattactgtcagcaatatacgagacgcactgtggtcgttacggaccgaacgggaccgaagggtacggaaactaccgaaacgtaacgtggtacggtactggaccaccgtagttaccgtgttaccg

SEQ ID NO: 103602 - DNA, 543 bp, Homo sapiens
  misc_feature: GYAE6OF02GUBBD.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccaggggaaagagccaccctctcctgcagggccagtcagagtgttggcagcaacttagcctggtaccagcagaaacctggccaggctcccagagtcctcatctatgctacatacaccagggccactgctatccagccaggttcagtgcaggtggtctgggacagagttcactctcaccatcagcagcctgcagtcagaagacttctgactacttttattctgtcagtctagtcttaataacggttgaccgtggtaaccgttcggaccgaaggggaccgaaagggttcggaaaattaccggaaaacggtaacgttacggtacggtactacggaccaaccgtacgttcttacgg

SEQ ID NO: 103603 - DNA, 585 bp, Homo sapiens
  misc_feature: GYAE6OF02G8Y6F.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgtggcagcaacttagcctggtaccagcagaaacctggccaggcctcccgaggcctcctcattcgtttggtcgccgtcccaccgacggggcccacgtcggccacgtccccaagacctaggttccaggtcggcagggtcgggtctgggacagacttcactctcaccatcagcagtacttgacgtcctagaagtatttgactagttatattacgtgtacagtacaagtactacgagacgctacgtggtcgggtccgttcggaccgaacgggaccgtaagggtacggaaacgtaacgaaacggtaacgttaggtacggtacgtacggaccgtaaccgtagttccgttagttaccg

SEQ ID NO: 103604 - DNA, 730 bp, Homo sapiens
  misc_feature: GYAE6OF02HMUCR.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatactactggagaaatagtgatgacgcagtctccagccaccctgtctgtgtccccaggggaanagccatccctctcctgcgacgggccagtcagtagttaattacgacctaacctaaacgttacgccgttacggtaccacgacaaacgaaaccgtcggaccaacgaccctacccgacggtccttccgtactactctagtggtcgaccacgtcccaacggaccggccacgttacgtaccgtcccgaggtacgtacggttcgaggtcggacgtagggttcgggtcgtagggacaggtacgttacacttacctaccgacctacgtaccgagacccgtacgttcgtacgacgttacgttacgtaagttagtttacgtttttcgtaacgtttaacgtttttactacgttagtaccaacgttaccttaagttaaagttaaacggttacggtccgtacccgttaccgtaacttacccggttaccgttaaccggaccgtaacggtacctaacggttaccggtaaggtaacgttaaacgttaaaccgacggtttcgtacgtaccgtaacgtaccccgttaacgttacgttccgtttaacg

SEQ ID NO: 103605 - DNA, 539 bp, Homo sapiens
  misc_feature: GYAE6OF02GJ3L4.34.34.D01.1.454.CMB.1.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctcccagacgtcctcatctatgctacactccacagggccactgctatccagccaggttcagtgcagtggtctgggacngagttcactctacaccatcagcagcctgcagtcngaanttctgctacttttatacttgtacagtctagtactaagtacgtcggtaccgtggtaccgttccggaccgaagggaccgaagggtaacggtaaactaccgaaaacggtaccgtaggtacggtactacggaccaccgttagttccgtacgg

SEQ ID NO: 103606 - DNA, 626 bp, Homo sapiens
  misc_feature: GYAE6OF02JQ6U5.34.34.D01.1.454.CMB.1.raw
  modified_base (409)..(409): a, c, t, g, unknown or other
  misc_feature (409)..(409): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcgagggccagtcagagtgttggcagcaacttagcctggtaccagcagaacctggccaggcctacccagacgtcctcatctatcgacctacactccaccgagggccactgccttacttccacgcctacggttcaggtcggctaggtcgggtcgtacgggacagtacgttcactctacacctagtcacgtcncgaccgtgcctaggtcgtagaaacgtactttcgtgtaccttaaccgttttaattaccgtagtaccgacggttactacgttacttaaagtaacgggttcggtccgggtaggtaaccgggttcggaaccggtaacgggaaccggtaagggtacggtaaacgtccggtaaaaccggagtttacggtacggtcctaaggcccgtaaccgtagttcgttacg

SEQ ID NO: 103607 - DNA, 713 bp, Homo sapiens
  misc_feature: GYAE6OF02H0BMD.34.34.D01.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
tcagtacacgtgatcacgaccggtgctcgatttagatcgtctgtgttgggtttgggggaggaacgtgctcagttaggacccagacggaaccatggaagcccagcgcagcttctcttcctcctgctactctggctccagacaccactggagaaatagtgatgacgcagtctccagccacccttgtctgtgtctaccagggggaaaancgccacccttcnctgcgaacgggccagttcaggtgtcgtggcagacaacgttgcctcggtaaccagaccgaacgaaaccgttcggacccaaggtccctacccgaaggtacgtccctacactactagtcgactaacctactacccgaaccgacggaccttacgtcgtactacgttcacgactacggttcaggtcggactagggttcgggtacgtacggggactacgggtaacgttaccacgtttcctaccgaaccgtactaccgacgacgtacgcccgtacgacgtacggtacgtaagtaacgtactttaccgtacgttacctttaacgttttaacttacgtacgttacgaacgtactaacgttacgttaaagtacggttacgtccggttacggtaaccggtaccggtaaccggtaacggtaaccggtaaacggtaaacgggtaaacgtaaccggtaaaaccggtaacgtacggttaggacgttaccgaccgtaactacgtacgttcg

SEQ ID NO: 103608 - DNA, 549 bp, Homo sapiens
  misc_feature: GYAE6OF02HRPHI.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccaccggagaaattgtgttgacacagtctccagccaccctgtctttgtctccaggggaaanagcccaccctctcctgcagggccagtcagagtgttagcggctacttagcctggtaccagcagaaacctggccaggctcccaggctcctcatctatgatgcgtccaacagggccactggcatcccagccaggttcagtggcagtgggtctgggccagcttcactctcaccatcagcagcctagacgtacctaaagtattttagactaatttattactgtctagctgcgtagcaactcggtcctcccgtgacgcgtccgttcggccgagggaccgacgacgtggaacgtaacgttaaacgacgtggtacggacgttacgacctaaccgtattccgttgttccttaccg

SEQ ID NO: 103609 - DNA, 551 bp, Homo sapiens
  misc_feature: GYAE6OF02I9NV8.34.34.D01.1.454.CMB.1.raw
  modified_base (379)..(379): a, c, t, g, unknown or other
  misc_feature (379)..(379): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaacgagcccaccctctcctgcagggccagtcagagtgttggcagcaacttagcctggtaccagcagaaacctggccaggctcccagacgcctcatctatgctacatccaccagggccactgctattccagccaggtcagtggcaggtggtctggacagagttcactctcacgatcgancagcctgcagtcctagaagtattcgtagtctacttttatacttgtactagcaagttacttaaagttaacggtcgtaccggttggaaccggtttcgggacctaaggggtaacccgaagggttaacggaaagtaccgaaacgacgtaggtcggtctggaccacgattccgtacg

SEQ ID NO: 103610 - DNA, 604 bp, Homo sapiens
  misc_feature: GYAE6OF02H695Z.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaacatggaagccccagcgcagcttctcttcctcctgctactctggctcccagacaccactggagaaatagtgatgacgcagtctccagccaccctgtctgtgtctccgaggggaaagngccaccctctcctgcagggccagtcagagtgtggcagcaacttgcctggaccagcagaaacctggccaggcctcccagacgtcctcatctatcgactacactcccaccgacgggccactgctactccagcctaggttcaggtggctagggtgggtcgtaggggactaggtacgttcactctacaccatcgagccacgcctgcacgtctagaagtacttcgtgtacttacttttatacgtcgtcgagtactagttacgttaaagtaacggttcgggtaccgttagggtaaccggtttcggaaccgtaaacggggtaccgtaaaggggtcggtaaaacgtaccgaaaaccggttaacgtagggtacggtaccgtacggaaccctaaccgttacgtcgttacg

SEQ ID NO: 103611 - DNA, 538 bp, Homo sapiens
  misc_feature: GYAE6OF02IOJAB.34.34.D01.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagcccaccctctcctgcagggccagtcagagtgttggcagcaacttagcctggtaccagcagaaacctggccaggctcccagcgtcctcatctatgcctacactccaccngggccactgctattccagccaggttcagtgcaggtggtctgggacagagttcacttcctcaccatcagtcacgtcctgcctagtctagaagtntttcgngtacctacttttacttactgttacagtcctagtactaagttagcgggtcgtggtacgttccgggacacgggaccgtaagggtcgaaatacgaaacgtctaggtcgctacgactaccgtatcgtcg

SEQ ID NO: 103612 - DNA, 677 bp, Homo sapiens
  misc_feature: GYAE6OF02JYZZA.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaacctggccaggcctccagacgtcctcatctatgctacatccaccagggcccactcgacttacttccagtacccaggttcagtcggcaggtcgggtctgggacaggtacgttccgactccgtacaacccgattaccgagtcaacggtccctagccgaacgttcgtacggtaaagtcgtttaccgtcggtaccttaaccgttttttattaacccgtttggttaccgagtacccgttaaggtttaccttaaaacggttaacgggtttcggggttacccggttacgggttaacccgggtttaccggggacccgttaacgggggtaaccctaaagggggttacggtaaaacgtaaccggtaaaacggtaccggttagggtacgggtaccgtagaacccgaccgtattccgtttacgg

SEQ ID NO: 103613 - DNA, 587 bp, Homo sapiens
  misc_feature: GYAE6OF02IJXHN.34.34.D01.1.454.CMB.1.raw
  modified_base (202)..(202): a, c, t, g, unknown or other
  misc_feature (202)..(202): n is a, c, g, or t
  modified_base (437)..(437): a, c, t, g, unknown or other
  misc_feature (437)..(437): n is a, c, g, or t
tcagtacacgtgatcacgaccggtgctcgatttagatcgtctgtgttggggtttgggggaggaactgctcagttaggacccagacggaccatggaagccccagcgcagcttctcttcctcctgctactctggctccagacaccactggagaaatagtgatgacgcagtctccagccaccctgtctgtgtctcgaggggaaangccaccctctcctgcagggccagtcagagtgttggcagcaacttagtctggtaccagacaagaaacctggccaggcctcccagacgtcctcatctatcgctacactccaccgagggcccacgtgtacctacttccgaggccctaggttcaggtcgggctaggttgggtctagggacaggtacgtttcacttctaccacactcacgcagcctagcctagtctaggaatacgtttcngtcttaactttttactactcgttacacgtcgtaacgtactaaagtacggttcggtccggttaggaccggttacggacgaacgggacctaagggtaacggtaaactacgaaacggtaacgtggtacgtacgtcgacctacgtactcgttcg

SEQ ID NO: 103614 - DNA, 779 bp, Homo sapiens
  misc_feature: GYAE6OF02JQUL5.34.34.D01.1.454.CMB.1.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
tcagtacacgtgatcacgaccggtgctcgatttagatcgtctgtgttgggtttgggggagggaacgtgctcagttaggacccagacggaaccatggaagccccagcgcagcttctcttcctcctgctactctggctcccagacaccactggagaaatagtgatgacgcagtctccagccaccctgtctgtgtctccgaggggaaanacgccaccctctcctgcagggccagtcagagtgtggcagcacttagcctggtaccagcagaacctggccaggctccagacgtcctnacgtctagtcgacctacgactcccgaccgtacggggaccctacgtcgtccttaacgttcccaaggtcccgtaacgggtttccaacggtttcggggaccttaacgggttcgggggttaccgttacggggggaaccctaagggggttaaccgtttccggaaaccctttcccggttaccaaccctaacgttaccgaacggtaccgtaaccggcccgttaggtaccgtaacgggttcctaacggtaaacgtaacgttttctaccggtaaccttactttttaacgttacctttagtccgtaacgtacgtaaccgttaacttaaacggttaacggttccggtaccggttacgggtaaccgttttccgggaacccgttaacggggaacccgtaaggggttaacggtaaaccgttaccggtaaaaccggttaccggttaaggttaccgggtaccgttaccggaacccgttaacccgtacgttaccgtttaaccgg

SEQ ID NO: 103615 - DNA, 540 bp, Homo sapiens
  misc_feature: GYAE6OF02G9SLQ.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangcccaccctctcctgcagggccagtcagagtgttggcagcaacttagcctggtaccagcagaaacctggccaggcctcccagacgtcctcatcctatcgactacactcccaccgagggcccactgctattccagccaggttcaggtgctaggtgggtctgggacagacttcactctcaccactcaccagactggacgcctagtaagtagttttgcgtagttgttaattactgtacaacgtagttggtactcacacacgtcggtacgttcggaccgaaggaccaggtagtaacgtacgaaacgaacgtgtgcgtacgccactacgtctgttcttac

SEQ ID NO: 103616 - DNA, 704 bp, Homo sapiens
  misc_feature: GYAE6OF02JCPJI.34.34.D01.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
tcagtacacgtgatcacgaccggtgctcgatttagatcgtctgtgttgggtttgggggaggaactgctcagttaggacccagacggaaccatggaagccccaggcgcagcttctcttcctcctgctactctggctcccagacaccatggagaatgtgatgacgcagtctccagccacctgtctgtgtctccgaggggaangccacctntccngcaggccagtcagngtgtgcngcaattgctggtacagcaagaactgccaggctccaggctcctcatctangactcgaccgtacaacgcgggacctactgggctaactcccgaagtccctaggttccgaggtggcttagggtcggttcgcgggacacggtaccttcgtacctctaccacctataccgaggccttacggccttaaggaccgtaaccttaaaaggttccttttaggaccctttaaagtttttacttaaccgttcggtacctaaggttccgttacgggtaccgttaacggtaccccttaaacggggttccggtacccccttttcggttaccgggaacggttacccccggtcggtttaacccggggcccggttaaacgggggaccttaacccgggttaccggtaaggggttaaccgttaaaacgggtttaaaccgaccgggtttaggtcccgggaccttttaaccgggacccgtttaaacccgtcgg

SEQ ID NO: 103617 - DNA, 578 bp, Homo sapiens
  misc_feature: GYAE6OF02I0MY9.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttgcctggtaccagcagaacctggccaggctcccagacgtcctcatctatcgactacatccaccagggccactgctatccagccaggttcaggtgcagtgggtctgggacagtagttcaccttcgtaccacatcagcacgcctgcagtctagatattcgtgacttactttattacctgtcagtctagttactaagttaacggttcggtaccggttaggtaccggttaccgggaccgtaacggggacctaaaggggttaacgggaaaacttacccggtaaaaacgtaccggtttaggtacgggccttaggaccctaaccgtagttccgttacg

SEQ ID NO: 103618 - DNA, 568 bp, Homo sapiens
  misc_feature: GYAE6OF02F7S00.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgttggcagcaacttagcctggtaccagcagaaacctggccaggctcccagagtcctcatctatgctacatccacagggccactcgctattccagccaggtcagtggcaggtgggtctggggactaggacgttccactccgtaccaccataccagccacgcctggccacgttctagaagtacttcgtcgtactaacttttattaccgtgttcagtcctagtacttaaacttaggtcgggtccgtagggtaccgttcgggaccgaacgggaccgtaagggtacggtaaacgtaccgaaacgtacgtgtacggctaggaccaccgtagtccttacg

SEQ ID NO: 103619 - DNA, 533 bp, Homo sapiens
  misc_feature: GYAE6OF02HW020.34.34.D01.1.454.CMB.1.raw
  modified_base (205)..(205): a, c, t, g, unknown or other
  misc_feature (205)..(205): n is a, c, g, or t
  modified_base (404)..(404): a, c, t, g, unknown or other
  misc_feature (404)..(404): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctgggcctcccagacaccactggagaaatagtgatgacgcagtctccagccaccctgtctgtgtctccaggggaaanagccaccctctcctgcagggccagtcagagtgttggcagcaacttgcctggtaccagcagaaacctggccaggctcccagagtcctcatctatgctacactccaccaggggccactgctacttccagcctaggttcagtggcagtgggtctgggacagagttcactctcaccatcagtccagcctagcagtctaggaanttctgacttactttactactgtcagctagtacttaataggttgaccgttggaccgttcggaccgtaagggaccgtaaggtggtaaactcgtaaacgaacgtgtacggactcgacgacctagtcgttacg

SEQ ID NO: 103620 - DNA, 752 bp, Homo sapiens
  misc_feature: GYAE6OF02F6T48.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgagggaaangccaccctctcctgcagggccagtcagagtgttggcagcaacttgcctggtaccagcaagaacctggccaggcctccgagacgtcctcacttctatcgacctacactaccgaaccgacgggtcccaacttcggaccttaacgttcccgaacggtcccgtaaggtttaccaacgggttcgggaccttaggggtttcgggttactagggggaaacctaggttacgtttacccgtaacttccgtaccaaccgtataccgacgtaccgtaacgtcccgtggacctaacggttcgtaaggtaacgttactttcgtcgtttacctttaacgtttttaacgttacgttacggttacgtaacggtacgttaacgtttaacctttaaacggttaacgggttcccgggtaccggttacgggtaacccggttttaccggggaacccgttaacggggaaccgttaaacgggtacgggtaaaaccgttaccgaaaaccggttaacgttcgggtacggttacccggttaacggtaccctaacccggttagttacccgtttacgg

SEQ ID NO: 103621 - DNA, 279 bp, Homo sapiens
  misc_feature: GYAE6OF02HH2GV.34.34.D01.1.454.CMB.1.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (269)..(270): a, c, t, g, unknown or other
  misc_feature (269)..(270): n is a, c, g, or t
  modified_base (272)..(279): a, c, t, g, unknown or other
  misc_feature (272)..(279): n is a, c, g, or t
tcagtacacgtgatcacgaccggtgctcgatttagatcgtctgtgttgggttcgtggacagagttcactctcaccatcagcagtcctgcagtctgaagattctgcactttattacgtgtcagcagtctaataagtggccgtggacgttcgccaagggaccaaggtgaaatcgaaacgaactgtggctgctaccntctgtcttacattcctcccgacagttctagatcacgtgtactgacgcgggntaggcaagggcgctagtaagcntnntnnnnnnnn

SEQ ID NO: 103622 - DNA, 673 bp, Homo sapiens
  misc_feature: GYAE6OF02GP4XD.34.34.D01.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
tcagtacacgtgatcacgaccggtgctcgatttagatcgtctgtgttggggtttgggggaggaactgcctcagttaggacccagacggaaccatggaagccccagccgcagcttctcttcctcctgctactctggcctcccaggatacccacttggagaaatagtgatgacgcagtctcccagccaccgtgtctgtgtctcgaggggaaangtcaccctntcctgcagggccagccaggacgtgttagcagcaacttggcctggtaccagcagaaacctggccaggctcccaggctcctcatcgtagtggtgcactccgaaccgacggggcctaacgtggtaactccccgaggcctaggtttcaggtcggacaggttgggtctggggacagtaattcactctacaccatccgagcacggcctcgacaggttctaggaacgtagttttcggacttaggttttaacttaccgtcgttacacgtacgttaaggttaacttaaacgtaacgttcgggacccgtttaccgggggaaccgtttaccggggaacccgtaacgggggtaacccgtaaggggttacggtaaacgtttaccggaaaaccggtaacggtcgggttaccgggtacgttacgggacccgtaaccgtaacggtttccgttacggttccgtttaaccg

SEQ ID NO: 103623 - DNA, 529 bp, Homo sapiens
  misc_feature: GYAE6OF02JBR2V.34.34.D01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (416)..(416): a, c, t, g, unknown or other
  misc_feature (416)..(416): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctntcctgcagggccagtcagagtgttggcagcaacttgcctggtaccagcagaaacctggccaggcctccagacgtcctcatctatgctacactccaccgtagggcccactcgactacttccagcctaggttcaggttgctaggtgggtcgtggggacagtagttcacttctacaccatcacgcacgcctgcagtcagatattctnctactttatactgtcagtctagtactaagtacgtcggtccgtacggtacgtcggacgagggtacctaagggtagaaactcgaaacgtacgtggtcgctgacctactactctcg

SEQ ID NO: 103624 - DNA, 592 bp, Homo sapiens
  misc_feature: GYAE6OF02G5SCF.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaacttagcctggtaccagcagaaacctggccaggctcccagacgtcctcatctatgactacatcccaccgacgggccactgctactccagcctaggttcagtgcgaggtcgggtctgggacaggtacgttcactcctacaccatccagccagcctgctaggtctaggagtattcagtcttactttatactgtacagtactagtacttaaagtagttcgggtccgtagggttaccgttccgggaaccgtaacgggggtacccaagggggttacggaaaaccgttaaccgaaaaccgggtaacgttgggtacggtaccgttaggaacccttaacctaggttcctttacgg

SEQ ID NO: 103625 - DNA, 506 bp, Homo sapiens
  misc_feature: GYAE6OF02F4S1D.34.34.D01.1.454.CMB.1.raw
  modified_base (364)..(364): a, c, t, g, unknown or other
  misc_feature (364)..(364): n is a, c, g, or t
  modified_base (434)..(434): a, c, t, g, unknown or other
  misc_feature (434)..(434): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttggcagcaacttagcctggtaccagcagaaacctggccaggctcccagacgtcctcatctatgctacatccaccgagggccactgctacttccacgccaggttcagtggcagtgggtctgggacagngttcacgtctcaccatcgagcagcctgcagttcctagaaagtcttctgctactttatactgtcagcagtntaatagtggcgtgacgttcgcgaggacaagggtgaaatacgaaacgagtggtagcgtcgacacctatctacg

SEQ ID NO: 103626 - DNA, 620 bp, Homo sapiens
  misc_feature: GYAE6OF02H1DJ6.34.34.D01.1.454.CMB.1.raw
  modified_base (206)..(206): a, c, t, g, unknown or other
  misc_feature (206)..(206): n is a, c, g, or t
  modified_base (435)..(435): a, c, t, g, unknown or other
  misc_feature (435)..(435): n is a, c, g, or t
tcagtacacgtgatcacgaccggtgctcgatttagatcgtctgtgttgggtttgggggaggaacgtgctcagttaggacccagacggaaccatggaagccccagcgcagcttctcttcctcctgctactctggctcccagacaccactggagaaatagtgatgacgcagtctccagccaccctgtctgtgtctccgaaggggaaanacgccaccctctcctgacgagggccagtcagagtgttggcagcaacttagcctggtaccagcaagtaaacctggccaggctcccagtacgtcctcatctatgctaacactccgacgacgggcctactgtctactccaagtcctaaggttcaaggtcggctagggtgggtctacggggacagtagttccactcgtaccacatcagcaacgtcctgacaggtcagtaaagntttcgctctaacttttatcgtgtacgacgtactagtacttaaacgtaacggttgggtacccgttggggaaccgtttaccgggaccgtaacggggaacgtaaacgggtaacgggtaaaactacggtaaaaacgtaaccggtaggtacgggtaccgtaccggttaaccgaaccgtactcgtttccgg

SEQ ID NO: 103627 - DNA, 549 bp, Homo sapiens
  misc_feature: GYAE6OF02JD3NU.34.34.D01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (399)..(399): a, c, t, g, unknown or other
  misc_feature (399)..(399): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgttagcagcaacttggcctggtaccagcaagaacctggccaggctcccaggcctcctcatctatggtncatccacgnggccagtggtactcccagcctaggtcagtgcaggtggtcngggacagacttcactctacacatcagcacgcctgcagtctgtaacgtntttgctagtttactacgtgtcagtactagtaattaacgtacgtcggacccgtcggggtaccgtcggacgtaacgggacctagggtacgtaacgtaaccgaaacggtactggtacggtctacggacctaccgtagttcgtacgtccttacg

SEQ ID NO: 103628 - DNA, 631 bp, Homo sapiens
  misc_feature: GYAE6OF02GUKDP.34.34.D01.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagngtgtggcagcaacttgcctggtaccagcacgaaacctggccaggcctcccagcgtccctcatctatcgactacactccaccgagggccactgcctacttccacgcctaggttcagtcggctagggtgggtctgggactaggtacttccacttcctacaccgactacgacgcgtaacggtcccttggacctagttccgtaggtaaactcgtttccgtaggtaccctttaagttttacttaccgtacgttaccgaggtactacgtttacgttaaagttacggttcgggtccggtttaggtaccggttacgggaccgaacggggtacgtaagggttacggtaaacttacggaaaaccggttacgtacggtacggtctacggacctaccgtacttcgttacg

SEQ ID NO: 103629 - DNA, 700 bp, Homo sapiens
  misc_feature: GYAE6OF02J1ZM4.34.34.D01.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaanagccaccctctcctgcagggccagtcagagtgttggcagcaacttagcctggtaccngcagaacctggaccaggctcccagacgtcctcatctatgctacactccaccgacggccactcgctacgttccagccgaggttcagtcgggctaggtcgggtctgggactaggtacgttcaccgttcctaccacctactacgtacgccgacggcccgttagaccgtaacggttcctaaggaaacgtacttttaccgtacggtaccctttaacgtttttaactttaccgttacggttaccgaacggtaccgttaagtttaacccgtttaaaaggttaacggtccgggggtcccggtttagggttaaaccccggtttccgggaacccggtaaacgggggtaacccgttaaaggggtaaccggttaaaactaacccgtaaaaacggttaacggttacggtacgggtacgtaccggacctaaccccgtacgtttacccgttaccgg

SEQ ID NO: 103630 - DNA, 619 bp, Homo sapiens
  misc_feature: GYAE6OF02H6NY7.34.34.D01.1.454.CMB.1.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggaagaaatagtgatgacgcagtctccagccaccctgtctgtgtctcgaggggaanacgccaccctctcctgcagggccagtcagagtgttggcagctaacttagcctggtaaccagcaacgaactcggccaggctcccagacgtccctnactctatcgactacactccacgacgggtccacgtcgcttactccgacgtcccgtaggttccgagtggacgtagggtgggtccgtagggaccagtacgttcaacgtctaccacatacgacgcacgcctagctacggtactagaacgtacttcgtagtacttacttttatacgtgtactacgtagtacgttaacttaagttacggttcggtaccggttcggtaccggtttccgggaccggtaacgggacggtaacgggtacggaaacgtacggaaaccggttagtacgggtcggacgtccggaccgaccttaccgtgttaccgg

SEQ ID NO: 103631 - DNA, 634 bp, Homo sapiens
  misc_feature: GYAE6OF02JC4HO.34.34.D01.1.454.CMB.1.raw
  modified_base (207)..(207): a, c, t, g, unknown or other
  misc_feature (207)..(207): n is a, c, g, or t
  modified_base (627)..(627): a, c, t, g, unknown or other
  misc_feature (627)..(627): n is a, c, g, or t
tcagtacacgtgatcacgaccggtgctcgatttagatcgtctgtgttgggtttgggggtagggaacgtgctcagttaggacccagacggaaccatggaagcccagcgcagcttctcttcctcctgctactctggctcccagacaccactggagaaatagtgatgacgcagtctccagccaccctgtcctgtgtctccgaggggaaanacgcccaccctctcctgccgagggccagtcaggacgtgtggcagcaactcgcctggtaccagcaagaacctggccacggcctacccgaggacgtcccttacgacttctatcggcctacactcccaccgacgggcccactcgcttattcccgagcccaggttcaggtcgctagggtggtctaggggacaggtacttcacgttcctcgaacccatcccacggtcccaccgtcgaccgtacggttcgtaacgtaaggtaccttcgtcgtaccttaaccgttttatttaccgtcgttacaggtccgtaagttaccttaaagttaagggttccgggacggttaccggtacgttccgaccgaagggaccgtaagggtcgaaacgtacaaacggtcttacggcggtaccgcgtaccacgtacttcgngtttacg

SEQ ID NO: 103632 - DNA, 539 bp, Homo sapiens
  misc_feature: GYAE6OF02G0WLP.34.34.D01.1.454.CMB.1.raw
  modified_base (241)..(241): a, c, t, g, unknown or other
  misc_feature (241)..(241): n is a, c, g, or t
  modified_base (335)..(335): a, c, t, g, unknown or other
  misc_feature (335)..(335): n is a, c, g, or t
  modified_base (436)..(436): a, c, t, g, unknown or other
  misc_feature (436)..(436): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtccaccctctcctgcagggccagccagagtgttancagcaacttggcctggtaccagcacgaaaccgtggccaggcctcccaggcctcctcatctagtggtcgcactccaccgacggccacgtggtacncccagcctaggttcaggtgcgaggtgggtctgggacagtattcactctccactatcagcacgcctgaccagtcgtagtagttatttgacttagtttacttntcgtcagtctagttactaagtagtcggtcgtaggtaccgtcggacgaagggactaggtagaacgtacgaacgagtgacgtcgtcgacactagtcttcgtctcg

SEQ ID NO: 103633 - DNA, 494 bp, Homo sapiens
  misc_feature: GYAE6OF02FOPNK.34.34.D01.1.454.CMB.1.raw
  modified_base (202)..(202): a, c, t, g, unknown or other
  misc_feature (202)..(202): n is a, c, g, or t
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (490)..(490): a, c, t, g, unknown or other
  misc_feature (490)..(490): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcttgctactctggctcccagacaccactggagaaatagtgatgacgcagtctccagccaccctgtctgtgtctccaggggaanagccaccctctcctgcagggccagtcagagtgttggcagcaacttagcctggtaccagcagaaacctggccaggctcccagacgtcctcatctatgctacatccaccagggccactgctatccagccaggttcagtgcaggtggtctgggacngagttcactctcacctatcagcagcctgcagtctgaagnttctgctacttntactgtcagcagtctaagtagtcgtcgtggtacgttcggaccgagggaccaggtacgaactcgaaacgagtgtggctgcacgtntctg

SEQ ID NO: 103634 - DNA, 593 bp, Homo sapiens
  misc_feature: GYAE6OF02IVG4P.34.34.D01.1.454.CMB.1.raw
  modified_base (406)..(406): a, c, t, g, unknown or other
  misc_feature (406)..(406): n is a, c, g, or t
tcagtacacgtgatcacgaccggtgctcgatttagatcgtctgtggttgggtttggggaggaactgctacacgttaggaccctagtaccggaacccatgggaaggccccagcgccagcttcgtcttcctccctgctactctggctcccgagacgacccacgtggagaaataagtcgtatgaccgaccagtcctccacgccaccctgtctgtgtcctccagggaaagacgcccaccctctcctgacacgggccagtccgagtaggtcgttggccaggcaacgttagccgtggtaccgagccagtaaaccctggaccaggtcctaccccagacgtcctcactcctatgctacatccaccaggtccactgctatcccagacctagtacagtcgcgagtggtctaggacngtagttccactccgtcgaccacgtcagtccacgcctgcgaggtcggtacggaactcgttcgcgtcttacttttagtacctgtcgacgactacgtacgtaacgtacgtcgtccgtacggtacgtccgaccgaagggaccgaaggtaggaactaccgaaccgtacgtcgtcgctacgccacgatctacg

SEQ ID NO: 103635 - DNA, 555 bp, Homo sapiens
  misc_feature: GYAE6OF02GIW60.34.34.D01.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (405)..(405): a, c, t, g, unknown or other
  misc_feature (405)..(405): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttagcctggtaccagcaagaaacctggccaggcctcccagacgtcctnatctatgctacatccaccgagggccatgcttatccagccaggttcagtggacaggtgggtctgggacagtagttcactctcaccatcagcagcctggctagtctagaactnttctgtactacttttatacgttgaccagcctagttactaagtaggtcggccgtaggtaccggttcgaaccgtaggggaaccgtagggtaacgtaaactaccggtaaaacgtacggttaggtcggtcttacgaaccaccgtattcgttacg

SEQ ID NO: 103636 - DNA, 588 bp, Homo sapiens
  misc_feature: GYAE6OF02J0095.34.34.D01.1.454.CMB.1.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaanagccaccctctcctgcagggccagtcagagtgtggcagcaacttgcctgtacngcagaacctggacagctccagngtcctcatctactgactacactcccgacgtagggccacgtgctactcacgctagtcngtgacgtagtcgggtcnggacagtcttcgactcncactgtcagtcagcctncgtagtcgtagacgtcttcgtacgtctaactttattacctacgtactacgtactacgttacgtaaacgttacggtacggttaccgttcgggtaacggttccggaaccgggtaacgggactaaacggggttaccggaaacgtacggtaaaacccgtagttacgtcgggtaccacgggtaccaaccggttacgttacgttaccgg

SEQ ID NO: 103637 - DNA, 555 bp, Homo sapiens
  misc_feature: GYAE6OF02G5HYW.34.34.D01.1.454.CMB.1.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccaggggaaangccaccctctcctgcagggccagtcagagtgttggcagcaacttgcctggtaccagcagaaacctggccaggctcccagacgtcctcatctatgctacatccaccagggccactgctattccagccaggttcagtggcaggtgggtctgggacagtacttcnctctcaccatccaccagactggacgcctagaagtattttgctagttgtattactgtactaactagttcggtctacgacacgtacgttcggtacgttccggaccgaagggaccgtagggtacggaaacgtacgaaacgtacgtaggtacgggtactacggacctaaccgtattcgttacgttccttaccg

SEQ ID NO: 103638 - DNA, 266 bp, Homo sapiens
  misc_feature: GYAE6OF02GT8OM.34.34.D01.1.454.CMB.1.raw
  modified_base (202)..(202): a, c, t, g, unknown or other
  misc_feature (202)..(202): n is a, c, g, or t
  modified_base (254)..(266): a, c, t, g, unknown or other
  misc_feature (254)..(266): n is a, c, g, or t
tcagtacacgtgatcacgaccggtgctcgatttagatcgtctgtgttgggtctgggacagagttcactctcaccatcagcagcctgcagtactgaagattctgcactttattactgtcagcagtctaataagtggccgtggacgttcggccaagggaccaaggtggaaatcaaaacgaactgtggctgcaccatctgtcttnatcttccgcatctgaatcacgtgtactgagcggctggcaaaggcgcatacgnnnnnnnnnnnnn

SEQ ID NO: 103639 - DNA, 523 bp, Homo sapiens
  misc_feature: GYAE6OF02FWEN7.34.34.D01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggtcagtcagcgttctaacaccgacttcttcgcctggtaccagcagagacctggccaggctcccaggctcctcatctatggtncatccacaggccactggtatcccagccaggttcagtgcagtgggtctgggacagaattcactctcaccatcagcagcctgcagtctagaagtattttgctagtttattactgtcagtcagtataataactggcctccgggacttcggacgtaaggaccgaaggtaggaacgttacgaaacgtaacgtacgtaggctagactaaccatacgtactcttacg

SEQ ID NO: 103640 - DNA, 595 bp, Homo sapiens
  misc_feature: GYAE6OF02HQPMX.34.34.D01.1.454.CMB.1.raw
  modified_base (211)..(211): a, c, t, g, unknown or other
  misc_feature (211)..(211): n is a, c, g, or t
  modified_base (395)..(395): a, c, t, g, unknown or other
  misc_feature (395)..(395): n is a, c, g, or t
tcagtacacgtgatcacgaccggtgctcgatttagatcgtctgtgttggggtttgggggagggaactgctccacgttagggtaccccaggacggaaccatggaagccccagcgcagcttctcttcctcctgctactctggctcccagacaccactggagaaattagtgatgacgtcagtctccagccacctgtctgtgtctcgagggaagnggccaccctctcctgcgacgggccagtcagagttgttggcagctaacttgcctggtaccagcagaacctggccagcctccagacgtcctcatctatcgcgtaacactccaccgtagggccacgtgactattaccagtcctaggttcagtcgcaggtggtcgtggacagtactcgactcgtcacntaccagcacgccgtaggactagtctaagaacgtacttcgtgtaccttagttttactacgttgtctagtctagttacttaagtacggttcggtcggtagtaacccggttgaccgaacgggttacgtaacggggtagtaaacggtaacgaaaccggtacgttaggtacgggtctacggtaccgtaacgtcgtacggttaccg

SEQ ID NO: 103641 - DNA, 511 bp, Homo sapiens
  misc_feature: GYAE6OF02FS7DL.34.34.D01.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcaacaacttagcctggtaccagcagaaacctggccaggcctcccgagagtcctcatctatgctacatccaccagggccactgctatccagccaggttcagtggctaggtgggtctgggacaggtacgttcactctacaccatcagcagcctgcagtctagaanattcngtactactttatactntcagcatctaatagtgccgtggtacgttcgacgacggacaaggtaggaatacgaaacgtacgttgnggactgaccacncttctgtcc

SEQ ID NO: 103642 - DNA, 867 bp, Homo sapiens
  misc_feature: GYAE6OF02GS8M4.34.34.D01.1.454.CMB.1.raw
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccccgtntgtgtctccgaggggaaanacgcccaccctctcctgcgacgggccagtcgagtaggttggtcggcagactaacgttacgccgtcggtaccagacgaacgaaaccgtcggaccacggcctacccgagacgttccctactactctagtcgacctacacctacccgaccggacggcctacgtcgtaccttaccgttaccgacgtccggtacggttacgagggttcggaccggtagggttcggggttacggtacgggaaccgtaaggttaccggtttacccaacgtttcccgttaacccaacccgtaacgttaccgaacgggtccgtaaccggtcccgttacggaccgttaccgggttacgtaacgggtaaacgtttcgtttaccgttaccggttaaccctttttaaaccgtttttacgtttaccgttcggttaaccgtaccggttaacggttaacgtttaaccggttaaaacggtttaaccggggttcccgggggttaacccggtttaccgggggtttaaacccggttaacccgggtaaacccggggtaaacggggtaacccgtaaagggggttaaaccgggtaaaacccttaaaccgggtaaaacccgggttcggttaaccgggttccgggtaaccgtaccggtaaccctaaccggtttacggtttccgttaacccggttcccg

SEQ ID NO: 103643 - DNA, 627 bp, Homo sapiens
  misc_feature: GYAE6OF02I7K8N.34.34.D01.1.454.CMB.1.raw
  modified_base (203)..(203): a, c, t, g, unknown or other
  misc_feature (203)..(203): n is a, c, g, or t
  modified_base (601)..(601): a, c, t, g, unknown or other
  misc_feature (601)..(601): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaancgccaccctctccgtgccagggccagtcagagtgttggcagtcaacttagcctggtaccagcagaaacctggccaggcctaccagacgtcctcatcgtatgcctacactccaccgtacgggccactcgcctattcccagcctaggttccagtcgtacgagtggtcgtgggacagtacgtcacgtctccacgtatcgacgcacgtcctgccgtagtcctggaaacgtctttcgtcgtaccttacttttattaccgtcgtacaacgtaccgtagttaccttaaagttaacggttcgggtacccggttagggtacccgtttaccgggaccgaacggggaaccgtaaggggtaaccggtaaaacgttaccggaaaaacctacggttacggtacggtccgtanacccaacccgttacgttccgttaccg

SEQ ID NO: 103644 - DNA, 208 bp, Homo sapiens
  misc_feature: GYAE6OF02HG1H6.34.34.D01.1.454.CMB.1.raw
tcagtacacgtgatcacgaccggtgctcgatttagatcgtctgtgttgggtctgggacagagttcactctcaccatcagcagcctgcagtctgaagattctgcactttattactgtcagcagtctaataagtggccgtggacgttcggccaagggaccaaggtaggaaatcaaacgactgtggactgcaccatctgtctcatctccgc

SEQ ID NO: 103645 - DNA, 649 bp, Homo sapiens
  misc_feature: GYAE6OF02GV19A.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaanacgccaccctctcctgcagggccagtcagagtgtggcagctaacttagcctggtaccagcagaaacctggccaggcctccagacgtccctcatctatcgcctacactacccaccgacgggcctactgccttacttcccagccctaggtttccgaagtcggcgtagggttcgggtcgtaggggacaggtacgtttcacttcctacgaccctatccgacgacgaacgtccgtgacctacggtccgtaaggaacgtactttcgacgttaaccttaccttttagttacctgttactacgtacttagttacgttaagttaacggtccgggtaccggtcggtaaccggttccgggaacccggtaacgggaccggtaaacgggtggaaaccgttaaccgaaaccggtacgttgggtacgtaccgtaccggaccctactacgtccgttacccgg

SEQ ID NO: 103646 - DNA, 728 bp, Homo sapiens
  misc_feature: GYAE6OF02HXNQY.34.34.D01.1.454.CMB.1.raw
tcagtacacgtgatcacgaccggtgctcgatttagatcgtctgtgttgggtttggggaggaactgctcagttaggaccctagaccggaaccatcggaaagccccctagcgtcgagcttctcttcctcctgctactctggcctcccagacaccacgtggagaaatagtggtatgtacgctagttctccagccaccctgtctgtgtctccaggggaagagtccacccgtcgtccgttgcgagggcccagtcgagagtcgttggcagctaacttagcctggtaccagcagaaccttggacctagtcccttacccaggacctccctactagttaacgtcggtcgactacgttaacctaacggacggggtaccccctgggacctacgtcccgaacggaccaaggttaccaaggtcggtacgaacgggttaggggtacgtagggtaacgtacggtaaccttcgtacctaccgtaccgacctacttacccaacccgacgtaccgtacggtacgacccgttaggaaacgttactttacggacgttagttacgttagtttacgtagttaccaaacgttagtttaccggtactaccgtacgacgtaacggtacggtacgggttaccggaccggtaaacggaccgtaaggtacgtaacgttaaccgaaaccggtacgtacggttacggacgtacgtaccaccgtacttacgttacgttaccgttacgtacgttaccccg

SEQ ID NO: 103647 - DNA, 824 bp, Homo sapiens
  misc_feature: GYAE6OF02JKOW5.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatgcccccggagaaattgtgttgacgcagtcgccagacaccctgtctctgtctccgaggggaaagacgcccaccctctcctgcgaggtcagtcacgtcgttctaacaccgtacttctcgcctggtaccagcagagacctggccaggcctaccgaggctcctactattccgtttgggcgccgttacccaccgtacgggacccacgtcgggcctaacgtccccgaggaaccgtacgggttacccaagggttccggaccgtaagggttccggggtcggttaccgggggaactacggtactttaccgtaccgttcgttacccgacctacgtaccgaacggtacgtaacggtacccgtttaggacgttcccgtaaggtaacggttttaacgttttcggaaccgtaaggtttaaccttaagtttaccgttacgggttacctaacggtaactaaacgttacggtaccggtaaaacggtacccggtaacccgtttacggggttacggttaccgggggttaccggtttaaccccgggaaacccggtaaaacggggttaccgtaaaaggggttacgtaaaaccttaaacccgggtaaacgggttaacgtttcgggaacccgggttaagtacccgggtaaccctaaacccggttagttacccggttttacccgttacggtttacccttaacccggg

SEQ ID NO: 103648 - DNA, 767 bp, Homo sapiens
  misc_feature: GYAE6OF02I30XO.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggagaaatagtgatgacgcagtctccagccacctgtctgtgtctccgagggaagcgccaccctctcctgcgagggccagtcagagtgttcggcagctaagttacgccgtaggtaccagcaacgaacctggaccaggcctaccgagtactcctctagtctagtcgcctactactacccaccgacgggcccacgttgaccttacgttacccgagtcccgtaaggtttccgacggttcggaccgtaacggggtttcggggtaccgttacgggggaaacctaacggggttaacgtttacccgtaaccgtttaccctaaccgtaaccccgttaacgtcccgtaaacggtccccgtaacgggtaccccgtttaggacccgttacgggttaccgttacggaaacgtttccgttacgttaccggtactttaaccgtttttaacgtaccgttaggtacctaacggttacgttaacgttaacgttaacggttaacgggttccggtaccgggtttacgggtaaccgttacgggaccggtaacgggtacggtaaacggggtacgtaaaccgtaccgtaaacggtaccgttagggtacgtccgtaacggaccctaacgttcgttaccgttacg

SEQ ID NO: 103649 - DNA, 797 bp, Homo sapiens
  misc_feature: GYAE6OF02HG44D.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctcagccaccctgtctgtgtctccgaggggaaanacgccacctctcctgcagggccagtcagtagtgttggcagcaacttagcctggtaccagcaacgaaccgtggaccacggcctacccgagtacgtcctcgactctacgtcgacctacactcccgaccgtacgggcctacgtgtactacttccgagtacctaggttaccaggttcgggacgtagggtttcgggtacgttacggggaactacgggtacgttccgaccgttccgtaccaacccgtaacttccgaacggtacccgaacggtcccgtacggtaccgtaacgttcgtaacggtaaacgttacgtttaccgttacggttaccttttaactttttacgtttaacgttacggttacgtaacggttaccgttaaacggtttaacgtttaaaacggttacgggttaccggggttaccgggttaacgggttaacccggggtttacccgggaacccgggtaaacggggtaacccggttaaagggggttaccggtaaaaaccgttaaaccggtaaaacccgggttaaccggtttacgggttacccgggtacggttaccggtaaccccgttaaccggttaacctttcccggtttaaccgg

SEQ ID NO: 103650 - DNA, 590 bp, Homo sapiens
  misc_feature: GYAE6OF02IP7HO.34.34.D01.1.454.CMB.1.raw
  modified_base (208)..(208): a, c, t, g, unknown or other
  misc_feature (208)..(208): n is a, c, g, or t
tcagtacacgtgatcacgaccggtgctcgatttagatcgtctgtgttggggtttggggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaagngcccacctctcctgcagggccagtcagagtgtggcagcaacttgcctggtaccagcagaacctggccaggcctccagacgtcctcactctagtcgactacactcccaaccgacgggcccagtcgaccttatccgacgtccgtaggttacaggtcggcgtaggttgggtcgtgggacaggtacgttacactcctacacctagtcagcacgcctgacagtacgtagaacgtcttacgcgtacttactttacttacctaggtctagtactagttactaagttaggtcggtaccggtggtaccggtaccgggaccgacgggtaaccgtaaggggtagaaacgtacgaaacgtacggtagtacggtctcgactaaccgtacgtctcg

SEQ ID NO: 103651 - DNA, 583 bp, Homo sapiens
  misc_feature: GYAE6OF02HO5HJ.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangcccaccctctcctgcagggccagtcagagtgttgcagcaacttagcctggtaccagcagaaacctggccaggctcccagagtccctcatctatgcctacactccaccgagggccactgctattccagccaggttcagtggcaggtgggtctgggacagtagttcactctcacatccagcagcctgctagtcgtagaagtattctagtccttaacttttattactgttacagtactaagttacttaaagtaacggttcgggaccgttaggtaccggtttacgggaccgtaaacggggtaaccgtaaaggggtaacggaaaacttaccgaaaacggtaacgttggtacggccgtaggaccctaaccgtagttccttacgg

SEQ ID NO: 103652 - DNA, 645 bp, Homo sapiens
  misc_feature: GYAE6OF02IN2SW.34.34.D01.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaangccaccctctcctgcagggccagtcagagtgttggcagcaacttgcctggtaccagcagaacctggccaggcctccgagacgtcctcatctagtcgactacactccaaccgagggcccaacgttgaccttacttcccagaccctaggtttaccaggttcggacgtagggtgggtctacggggactaggtacgttcaccttccgtaccacgatcgacncgtacgcctgccaggtctaagacgtntttcgacgtacttaacttttataccgtgtacgactacgtagttaacttaagtacggtcggtacggtacggtaccgggttaccgaccggtaacgggtaccgtaaaggggttacgtaaaaccgtaccggtaaaaccggtaacggttaccgggttacggtacccgtacggtacccgtaacccgttaagttcccggttaacgg

SEQ ID NO: 103653 - DNA, 558 bp, Homo sapiens
  misc_feature: GYAE6OF02GSNMQ.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaagagccaccctctcctgcagggccagtcagagtgttggcagcaacttagcctggtaccagcagaacctggccaggctccagacgtcctcatctatgctacactccaccagggccactgctatccagccaggttcagtgcgagtgggtcgtaggacagtagtcacgtctcaccatcagcacgcctgcagtctagagtcttctgcttattattactagtctagactacgtacttaaacgtaggttcggtccggtacggtacggttccggaccgtaacgggaaccgtaagggtacggtaaacgtacgaaaaccggttacgtacggtacgacggtaccgaccgtaccgtacgtcgttaccg

SEQ ID NO: 103654 - DNA, 721 bp, Homo sapiens
  misc_feature: GYAE6OF02IGR5U.34.34.D01.1.454.CMB.1.raw
  modified_base (203)..(203): a, c, t, g, unknown or other
  misc_feature (203)..(203): n is a, c, g, or t
  modified_base (540)..(540): a, c, t, g, unknown or other
  misc_feature (540)..(540): n is a, c, g, or t
  modified_base (574)..(574): a, c, t, g, unknown or other
  misc_feature (574)..(574): n is a, c, g, or t
tcagtacacgtgatcacgaccggtgctcgatttagatcgtctgtgttggggtttgggggaggaactgctcagttaggacccagacggaaccatggaagccccagcgcagcttctcttctcctgctactctggctccagacaccactggagaaatagtgatgacgcagtctccagccacctgtctgtgtctaccgaggggaaanagccaccctctaccgtgcgagggccagtcagagttgttggcagacaacttagccttaggtaccagccaacgtaaaccgtcggacctacggtcctacccgagtacgttaccctacacgttccgttaagtcggtacctaactacgttaccccgaacggtacgggtcccctaacgttcgtacctttaacgttccgaacggtaccggtacggtttaccgaaggtttcggaccgtagggttcggggttacgtacgggactaaggtcgtttaccgaccgttacctacccgaactaacgtcaaacggccgaacggtcctggaccgagttccgtagtaaacgttntttacgagtactttaaccgttttatacttacggntaacggtactacgtttaacttaaaggtacgggtccggtaccgtgggttaacgttcccgggaacgtaacggggtacgtaaagggttgaaaacgttacgaaaaccggtagttacggacgacgttacaccgttaacgtacgtcgttacgg

SEQ ID NO: 103655 - DNA, 613 bp, Homo sapiens
  misc_feature: GYAE6OF02IWR1O.34.34.D01.1.454.CMB.1.raw
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaagcgccaccctctcctgcagggccagtcagagtgttggcagcaacttgcctggtaccagcagaacctggccaggcctcccgagacgtcctcatctatcgctacactaccacgacggccactgctattcccagcctaggttagcggtactggtcgggtactgggactaggtgtacctactctaccgtacactcacgacacgcctggactgtaccgtagaagtacctttgtacgttcttaacctttttagttacccgttgtcaacgtccgtacgttacttaagttacgggtcggttccgggttacggtaccgggtttaccggaccggtaaggggaccgtaagggtaacgggaaacttaacgaaaacgggtacgtcggtacgtacggtcgtacctaccgtacttcgtcgttacc

SEQ ID NO: 103656 - DNA, 794 bp, Homo sapiens
  misc_feature: GYAE6OF02IZNRU.34.34.D01.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagtacacgtgatcacgaccggtgctcgatttagatcgtctgtgtttgggtttgggggaggaactgctcagttaggacccagacggaaccatggaagccccagcgcagcttctcttcctcctgctactctggctccagacaccactggagaaatagtgatgacgcagtctccagccacctgtctgtgtctcgagggaaangccacctctcngcaggccagtcagagtgttggcagcaacttagccgtaggtaccagacaacgaaaccgtcggaccgaacggccctacccgaagtacgtcccttacgacttacctagtcgacctaacgactaccccaaccgacgggaccctacgtcgtacttaacttccgaagtcccgtaaggtttccgaggttcgggaccgtagggttcgggttacgtaggggaactaaggtacggtttaccaacttccgtacgtaacccgtaacgtaccgtaacgaccgaacgtacccgttacggaccttaacggttaccgtaaggtaaacgttacgtttaccgtacgttaacctttaaaccgtttttaacgttaccgttaacgtaccgtaacgtaaccggttaacgttaaaccgtttaaaggttaacgggttacgggttacccggttacggggtttaaccggttaccggggtaacccggtaaaccgggggtaaaccgtaaaggggttaacggtaaaaacgttaaaccggtaaaaacggttaacggtacgggttacgggtaccgttaaccggaaccctaacccggttattacccgtttaccg

SEQ ID NO: 103657 - DNA, 728 bp, Homo sapiens
  misc_feature: GYAE6OF02IK3XP.34.34.D01.1.454.CMB.1.raw
  modified_base (708)..(708): a, c, t, g, unknown or other
  misc_feature (708)..(708): n is a, c, g, or t
tcagtacacgtgatcacgaccggtgctcgatttagatcgtctgtgttgggtttgggggaggaactgctcagttaggacccagagggaaccatggaaaccccagcgcagcttctcttcctcctgctactctggctcccagatcgcccccggagaaattgtgttgacgcagtcgccagacaccctgtctctgtctccgaaggggaagacgcctaccctctcctgcagggtcagtcagtcgtctaacaccgtacttcttcgcctaggtaccagcacgacgaccctggaccacgggtccctacccgacggtccctcccgtcgtactttccgttttacggtcgtacccggttacccgaacccggtaccggggaccctacggttacgggcctaacgtaccccgaagtaccgtacgggttaccgaggtcgggacctagggttcggggccgttaggggaccctaggtaccttcaccgttcgacctacctatacccgaagcctacgtccgtcgacctacggttctacggtaagtttacgtttcgacgttaagttacgttaacgtttacgtcggtacgaacgtaactaacgttaaacggtcgaacggtaccgtccgtacggttcgggttaccgggtcccgttacgggaaccggtaaacgggaacccgtaagggtacgaaacgtaacgaacggtacgttggtacgtctacggcaacctnttacgtcttccgtctacccg

SEQ ID NO: 103658 - DNA, 177 bp, Homo sapiens
  misc_feature: GYAE6OF02GN1VV.34.34.D01.1.454.CMB.1.raw
  modified_base (174)..(177): a, c, t, g, unknown or other
  misc_feature (174)..(177): n is a, c, g, or t
tcagtacacgtgatcacgaccggtgctcgatttagatcgtctgtgttgggtttgggggaagaggaagactgaccggtccccccaggagttcaggtgctgggcacagcggccctggctgcctggtcaaggactacttccatcacgtgtactgagcgggctggcaaggcgcatagnnnn

SEQ ID NO: 103659 - DNA, 516 bp, Homo sapiens
  misc_feature: GYAE6OF02GK99B.34.34.D01.1.454.CMB.1.raw
  modified_base (203)..(203): a, c, t, g, unknown or other
  misc_feature (203)..(203): n is a, c, g, or t
  modified_base (504)..(504): a, c, t, g, unknown or other
  misc_feature (504)..(504): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctcccagacgtcctcatctatcgactacactccaccgagggcccactcgctattccagccaggttcagtggctaggtggtctgggacagacgttcactctcacatcagcagcctgctagtctagaagtattctgctactttatactgtctagctagtactaagtagtggcgtggacgttcgaccgaagggaccaagggtcgaactacaaacgtacgtgtacggctacgntaccgatctacg

SEQ ID NO: 103660 - DNA, 648 bp, Homo sapiens
  misc_feature: GYAE6OF02JRMFR.34.34.D01.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccacctgtctgtgtctccgaggggaaancgccacctctcctgcgagggccagtcagacgtgttggcagcaacttgcctggtaccagcaagaaccgtggaccaggcctccagacgtcctcagtctatcgctacactccacgacggccatcgctactccagcctaggttcagtcggacgtaggtcggtacgtgggactaggtacgttaccacgtcctcaaccgtanaccgaacgtcgaacgtcctagaccgtaaggtcctaagggtacactttcgcttaccttattttacgtactgactacgtactacgttaacgtaacgttaacgggttcggtaaccggtttacgggtaaccgggttaccggaacccgggtaaagggtaaccggttaacggggtaacggtaaaacttacccggtaaaaacggtcggttacggttacgggacctaacgtacggaaccctttaggtaccgtttaccg

SEQ ID NO: 103661 - DNA, 608 bp, Homo sapiens
  misc_feature: GYAE6OF02GV4NN.34.34.D01.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctccagacgtcctcatctatcgctacatccacagggccactgctattccagccaggttcagtggcagtggtctgggatagagttcactctcacatacngcagcctgactacgtcgtacgaaggtacttctaggtaccttacgttttattactggtaccaggtacctagttacccttaaagtaacggttcgggtaccgttacgggtaaccggtttccgggaaccggtaacggggtaccgtaaacggggtacgggtaaaacgttaccggaaaaacccgtaacggttacgggtcggtaccgttaccggaaccgtaaccgtacttaccgttaaccgg

SEQ ID NO: 103662 - DNA, 735 bp, Homo sapiens
  misc_feature: GYAE6OF02G1D9F.34.34.D01.1.454.CMB.1.raw
  modified_base (216)..(216): a, c, t, g, unknown or other
  misc_feature (216)..(216): n is a, c, g, or t
tcagtacacgtgatcacgaccggtgctcgatttagatcgtctgtgttggggtttaggggggaggaactgctcagttacggacccacgacgggaacctatggaagtccccagtcgcagcttctcttcctcctgctactctggctccgagtacaccactggagaaatagtgatgacgcagtctccagcccacctgtctgtgtcctccgaaggggaaancgcccaccctctcctgacgacgggccagtcagagtgttggcagctaacttgcctggtaccaagacaaccgtacgcgacgacgtccctacgacgtcctcctactactacgtacgtacctacctaactacccgtaaccccgaacgggacccggtacctacggttaccttaaccttaccgtaccggaccgtaccggtttaacgtacggtacgggtccggaggttacggggtcggtacgggtaacggagtacgttccgtacctccttaccacacctacgacgtcgaccgtacgtctagtacgtctaacggtaagtacgttacgtcgtaacttacctttttaattaccttacgtacgtactacgtaacttagttaaacgttaacggtcggggttccgtacgggtacgttaacccgggtacggaaccgggtaacgttaaggtagggtaaaactaaccggaaaccgtaaaggtcggttagggaccgtaccgttaaccgaaccgttaacgttttcgaccgtttaccg

SEQ ID NO: 103663 - DNA, 571 bp, Homo sapiens
  misc_feature: GYAE6OF02FUZ3Y.34.34.D01.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaangccacctctcctgcagggccagtcagcgttctaacnccgacttcttcgcctggtaccagcagagacctggccaggctcccaggcctcctcatcgtttggtcgcgtccacgacgggccacgtcggcactcccagacaggttcaggtgcgaggttcgggtcgtcgggacaggtactcactctcacctatcagcagacttagacgtcctagaagtatttgatagtattacttacgtgtactagactaaatatacgagacgctacgtggtacgggtccgttcgggaccgtaagggaccgtaagggtacggtaaactaacgaaacggtacgtaggtacggaccgtggaccctacgacttacgttcgttaccg

SEQ ID NO: 103664 - DNA, 698 bp, Homo sapiens
  misc_feature: GYAE6OF02JXGZ7.34.34.D01.1.454.CMB.1.raw
  modified_base (210)..(210): a, c, t, g, unknown or other
  misc_feature (210)..(210): n is a, c, g, or t
tcagtacacgtgatcacgaccggtgctcgatttagatcgtctgtgttgggtttgggggaggaactgctcagttaggacccagacggaaccatggaagccccagcgcagcttctctcctcctgctactctggctcccagacaccactggagaaatagtgatgacgcagtctccagcccaccctgtctagtgtcttaccgaagggggaaacncgacccaccctcgtccctgcgacgggcccaggtcagagttcgttggccagcaacttagccctaggtaccagccaagaaaccctggaccaggcctaccccagacgtcctcatactatgcctacacctccaccgagggccactgactatcccagccgtagttcagtcggcgtacgtgggtcgtgggacacgtagttcaacgtttccacgtacctacgtccaggtaccaggtccctggtacccagttaccgtaggtaaacgtcgttaccgttagtaccctttaactttagtttaaccctggtttacgacggtaccgttaactaccgtttaaaaggttaaccggttcggtacccgggtttacgggtaacccgggtttaccggaacccggtaacggggttaaccgtaacgggtaaacgggtaaaccgttaccgaaaacggttaaccgtagggtccggttacgaccggttaccacccgttaggtcctttaccgg

SEQ ID NO: 103665 - DNA, 949 bp, Homo sapiens
  misc_feature: GYAE6OF02HE3HT.34.34.D01.1.454.CMB.1.raw
tcagtacacgtgatcacgaccggtgctcgatttagatcgtctgtgttgggtttgggggaggaactgctcagttaggacccagacggaaccatggaacgccccagcgcagcttctcttcctcctgctactctggctcccagacaccactggagaaatagtgatgacgcagtcctccacgcccacccgtgtctgtcgtcctaccggaaggggaaagacgccctaccctctcctgcgacgggccagtcagagtggttggcagactaactcgccgtacggaccagacaacgaaccgtcggaccgacggccctacccgagtaccgtccctacattcctagtcgtacctaaccacctaccccgaccgaacgggtccctacgtcgtaccttaaccgttcccgaacggtacccgtacgggttaccaacggggttcgggaccgttaggggttcggggttacggtacggggtaacgtaacggtttaaccggttcctaaacccgtttcccgtaacccgaacccgtacgtacccgtaaccggtaaccgtaaccggtcccgttacggtaccgttacggttaccggtaaagggtaaaccgtttacgttttacccgtacggtttaaacccgtttttaaaccttttttaaccgttaccggtacgttacccggtaaacggttaaccctttaaacgggttttaaaccgttaaaacggtttaaccggggttaccggggttacccgggttttaaaccggggtaacccggggttttacccgggaaaaccccgggggttaaacggggtaaacccgggttaaaacgggggttaacgggttaaaaaacccccttaaaccgggggtaaaaaccccggtttaaccggggttaacggggttaacccggggttaaccccgggttaacgggtaacccccgttaaaccgttacccggttttacccggtttaaccccggg

SEQ ID NO: 103666 - DNA, 645 bp, Homo sapiens
  misc_feature: GYAE6OF02GGDYQ.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccctctcctgcagggccagtcagagtgttggcagcaattagcctggtaccagcaagaacctgccaggcctccagcgtcctcatctatcgctacactccacgacggccactgctattccagcctaggttcaggtcggcgtaggtgggtcgtggggactaggtacgttaccacttccgtaccacccagttaccacggtaccacgtcccgttaggaccgtagtaccgttaaggaacggttatttaccgcgttactttaaccttttaattaccgtcggttacacgtcgttaagtacgttaaaggttaggttccggggacggtttacgggtaccgttaccgggaaccgaaacggggtaccgtaagggtaacgggtaaacttaaccggaaaacggtaccgttagggtaccggtacggtacgaccctaacgtacttcgttacg

SEQ ID NO: 103667 - DNA, 753 bp, Homo sapiens
  misc_feature: GYAE6OF02I52OP.34.34.D01.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagtacacgtgatcacgaccggtgctcgatttagatcgtctgtgttgggtttgggggaggactgctcagttaggaccagacggaaccatggaagccccagcgcagcttctcttcctcctgctactctggctcccagacaccactggagaaatagtgatgacgcagtctccagccaccctgtctgtntctcaggggaancgccaccctctcctgcagggccagtcagngtgttggcagctaattncctgtaccagcagaacctggaccaggtccctcccagacgtcctactactatancggtacctacactaccccgaaccgacgggcccctacgtcgtaccttacttacccgacggacccttaacgggtttcaacggggtttcggacgtaggggtttcgggtacgttagggggaacttaggtacgtttcccgacttacctaccgtaacctatacccgaggtccacggtaccctcggtaccgttaacggtcgttaacggtaacggttaacttttcgtacgttaccgtttaacttttaaccgtttacgtacggtttccacgggtacttacggtaaccgtttaaagttaaacgggtttccggggtaccgggttaccgggtttaaccgggttaccggggtaacccggtaacgggtaaccggtaaacggggttacgggtaaaaccttaaccgggaaaaccggtacggttacgggtaacggtcccggttacggacctaaccgtacgttccgttaccgg

SEQ ID NO: 103668 - DNA, 606 bp, Homo sapiens
  misc_feature: GYAE6OF02F4FWM.34.34.D01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctntcctgcagggccagtcagagtgttggcagcaacttagcctggtaccagcagaaacctggccaggctccagacgtcctcatctatgctacactccaccagggccacgtcgctattccgagtccaggttcagtggcaggtgggtctagggactagagtttcacgtcctcaacctactcagcaagcctgctagtcctaggaaactattacgtagtctaacgttttacttacgttagtcgaagtccagtttactaaacgttaagtacgggtccgttaggtaccgttaccgggaccgtaacgggtaaccgtaacgggtaacggaaacgttaccgaaaaccggtaacgttacggtacgggtcttaaccggacctaacccgttagttacccgtttaccgg

SEQ ID NO: 103669 - DNA, 615 bp, Homo sapiens
  misc_feature: GYAE6OF02JIGL3.34.34.D01.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagtacacgtgatcacgaccggtgctcgatttagatcgtctgtgttgggtttgggggaggactgctcagttaggacccagacggaaccatggaagccccagcgcagcttctcttcctcctgctactctggcttccagacaccactggagaaatagtgatgacgcagtctccagccacctgtctgtgtctccgagggaaancgccaccctntcctgcaggccagtcagagtgtgcagcattagcctggtacagcagaaacctggcaggctcccagacgtctcagtctatgactacactccaccgacgggtccacgtcgactactcacgtcctacggtcagtcggctaggtggtacgtggggaacaggtacgttcacttcacaccattcacgcctagcccgttaggactaacgttcgacggaaagttctttaccgtggtacctttaacttttaacgttacgtggttaaccaggccttaagttaccgtaaagttacggtcgggtaccgtaagggtaccgttacggaaccggaccgggtaacgtaaggtacgggtaaactaacggtaaaaccgtagtttcgggagtaccgttacgaccgtaacctacgtcgttaacgg

SEQ ID NO: 103670 - DNA, 556 bp, Homo sapiens
  misc_feature: GYAE6OF02FW4YY.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggccagtcagagtgttggcagcaacttacgcctggtaccagcagaaacctggccaggctccagacgtcctcatctatgctacatccaccagggccactgctattccagccaggttcagtgcaggtgggtctgggacagacgttcgactctacaccatccagcagtcctgactagtctagagtattcgagccttatttacgttactcgttcagtctagtactaaagtacggtgggtaccgttaggtaccggtttccggaaccgtaagggacccgtaagggtaggaaactacgaaaaccggtagtaggtacggacgtcgaccaacgtcttacgttcg

SEQ ID NO: 103671 - DNA, 549 bp, Homo sapiens
  misc_feature: GYAE6OF02G5DQG.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaactgcctggtaccagcagaaacctggccaggctcccagacgtcctcatctatcgactacactccaccacgggccactgctatccagccaggttcagtgcagtggtctggacagagttcactctcaccatcagcacgtcctgctagtctagaagtattctagtcttacttttattactgtacagtctagttacttaagtacgtcggtccgtaggtaccgttcggaccgtaacgggtaccgaagggtacggtaaataccgtaaacgtacgttaggtacggtcctaggacccgtaacgtactcgttacg

SEQ ID NO: 103672 - DNA, 511 bp, Homo sapiens
  misc_feature: GYAE6OF02F5TVN.34.34.D01.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttgcctggtaccagcagaaacctggccaggctcccagagtcctcatctatgctacatccacagggccactgctattccagccaggttcagtggcagtgggtctgggacagngttcactctcaccatcagcacgcctgccagtcctgaagatttctgctacttttattacttgtcagtcagttactaatagtcgcgtggtacgttccgacagggaccaagggtggaaactcgaaacgactaggtaggcgtacgcacctatcgttacg

SEQ ID NO: 103673 - DNA, 726 bp, Homo sapiens
  misc_feature: GYAE6OF02JL9P5.34.34.D01.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtcnccagccaccgtgtctgtgtctccgaggggaaacngtccaccctctcctgcgagggccagccagagtgttagcagcaacttggcctggtaccagcaacgaaccgtggaccagggcctacccgaggcctccctacattccgtatcgggtnacctactcccgaccgagggtccccagttcggtacctcccgacgccgtaggttcgaggtcggactagggttcgggtactaggggacctaagtaacttctaacctctaccaacctacgtcgacgacctacgcccgtagtactacgttacgtagtaaacggttacgttttaggtacctttaaggttttaacttaacgttcgtactacgtacgtaagtttaacttaaaacgttaaccggttaccggttaccccggttaaccggggggttaccgttaaccgggtaacccgggtaaacgggttaaccgtaaccggggttaaggtaaccggttaacggtaaacggtaaccggttagggtaccgggtacgtaccgtaccggtaacccgtaccttacgttaccgttacctttaccg

SEQ ID NO: 103674 - DNA, 606 bp, Homo sapiens
  misc_feature: GYAE6OF02FWSFJ.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaangccaccctctcctgcagggccagtcagagtgttgcagcaacttagcctggtaccagcagaaacctggaccaggcctacccagtacgtcctcatctatcgactacactccaccgacggccacgtgacttacttccagcctaggtttcaggttcggacgtaggtgggtctaggggactaggtacgttcacttctacacctatccagtcacgtcctgacctaggtcctagaacgtgtttactcgtaccttaacttttattacgttcgtacgtacgtactacgttaacttaaaggttacggtcgggtaccgttagggtaaccgttaccgggaccgtacgggaccgtaagggtaacggaaacttacggaaacgtacgttcggacgtctaccgacgtactagttcttacg

SEQ ID NO: 103675 - DNA, 733 bp, Homo sapiens
  misc_feature: GYAE6OF02FOY0V.34.34.D01.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaaatgtgatgacgcagtctccagcccaccctgtctgtgtctccgaggggaaancgcccaccctntcctgccagggccagtcagtagtgttggcaggcaacgttgcctgtaccagcagagacctggaccgaggcctcccgaggtcctacctctattcgtttagggtcgtccgtccaccgtacgggccaccgttggcctaccgtccccgagtaccgtacggttacacggtcggcgtacgggttcggggtacgttacgggggaactacggtaacctttccgtaacccttccggtaccctaacccgtacgtacccgtaacgtaccgaacggtaaccgtttacggacggttacccgtaggttaaaggttacgtttttcggacgtttaagttaacgtttaatttaccgtacgttacgtaacggtacctaaattacgttaccggaacgtaaccgtacgtaacgttcggggttacggtccgttaccggggaacccgttaaggggaaccgtaaggggtaaacggaaaccgttaaccggaaagttacccgtgggttccggacgttacggacctaccgttacgtcgttaccg

SEQ ID NO: 103676 - DNA, 637 bp, Homo sapiens
  misc_feature: GYAE6OF02F3KLG.34.34.D01.1.454.CMB.1.raw
  modified_base (301)..(301): a, c, t, g, unknown or other
  misc_feature (301)..(301): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaagagtcaccctctcctgcagggccagccagagtgtagcagcaacttggcctggtaccagcagaacctggccaggcctccaggcctcctcatctatggtncactccaccgacgggccacgtggtactcccagcctaggttcaggtcggcaggttgggtcgtgggaacagaattccactctcaccataccagacacgcctcgagtacgtctaggtaagtacttttaggacgtttaagttttacttagtacgtactagtactaaggttaattaaacgtaaccgttcggtacccggtttaccgggggtaacggtttaccgggaaccggtaacggggtaaccgtaacggggtaccggtaaacgtttaaaccggaaaaccgttacggtacggttacggacgttacggacccgtaccgttaactcggttacgttccttaccg

SEQ ID NO: 103677 - DNA, 572 bp, Homo sapiens
  misc_feature: GYAE6OF02GW0CY.34.34.D01.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangccaccctctcctgcagggccagtcagagtgtggcagcaacttagcctggtaccagcacgaaaccgtggaccagggcctacccgagacgtccctcgatctatcgcctacactcccacgacgggccactgcctattccagtccaggttcaggtcggactaggtggtcngggacagtacttcactctcactntcagcagcctgctagtctaggaactnttcgtcgtacttactttattactcgtacacgtctacgtacttaagtagttcgggtccgttaggtaccggttccgaccggaagggtaccgaagggtacgaaactaccgaaacggtacgttggtacggctacggaccaccgtacgtacgttcg

SEQ ID NO: 103678 - DNA, 656 bp, Homo sapiens
  misc_feature: GYAE6OF02IXJ02.34.34.D01.1.454.CMB.1.raw
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtgtctccgaggggaaancgcccaccctctcctgcagggccagtcagtgtgtggcagcactgctggaccagcacgaaccgtggaccaggcctccgagacgtcctacgatctatcgactacnctacccgacgcggaccactcgtctacgtccagccctaggttccaggtcgctagggttggaccgtgggacaggtacgttccaccgttcctaccgaacctacgtaccgagcctacggtcctcggaactagttaccgtaggaacttcgttcgaccgttactttaacccgttttaacgttacgtacgttacgacgttaccgtagtttaacgtaaacgttacgggtccggttaacgggttccggttaccggttaccgggacgtaaacggggtacccggaaggtaacgggtaaacctaaccggaaacgttacggtccgtagggtaccctacgaccgttaacctgttaccttccg

SEQ ID NO: 103679 - DNA, 784 bp, Homo sapiens
  misc_feature: GYAE6OF02HBC3A.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgcccaccctctcctgcagggccagtcagagtgttggcagcaacttgcctggtaccagcaagtaaacctggaccaggccctcccgagtacgtccctacacttcctatcgacctaacacttcccgaaccgtacggggacccctaacgttcgtaacccttaacgtttaccccgacggtacccttaacgggtttaccacgggttcgggacctaacgggttcggggttaccgttggggaaacctaggtacgtttaccacttccgtaccaacctaacgtccaacggtcctaacgggcccttaggtccgtaacgttcgaacggtaaacgttacgtttaccgtcggtaacctttacgtttttaacgttaccgttccgttactaccggtacgttaacgtttaacctaaaggttaccgggttccgggtaaccgggttacggttaaccgggtttacccgggaacccggtaaggggtaacccggtaaggggttaaacggttaaacctaaccgggtaaaaaccggttacggttacggtaacgggttacctaccggaacccgtacccggtttaacgttcccggtttaaccgg

SEQ ID NO: 103680 - DNA, 499 bp, Homo sapiens
  misc_feature: GYAE6OF02IW8G0.34.34.D01.1.454.CMB.1.raw
  modified_base (204)..(204): a, c, t, g, unknown or other
  misc_feature (204)..(204): n is a, c, g, or t
  modified_base (375)..(375): a, c, t, g, unknown or other
  misc_feature (375)..(375): n is a, c, g, or t
  modified_base (499)..(499): a, c, t, g, unknown or other
  misc_feature (499)..(499): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaacngccaccctctcctgcagggccagtcagagtgttggcagcaactgcctggtaccagcagaaacctggccaggctcccgagagtcctcatctatgctacatccaccagggccactgctattccagccaggttccagtcggcagtggctgggacagagttcactctcacatcancagctgctagtctagaacgtattctgcttacgtttattactgtcagctagtcttaatagtcgcgtggacgtcgccgaggaccgaaggtgaaatcgaaagtacgtagtggctgaccactatcgtn

SEQ ID NO: 103681 - DNA, 681 bp, Homo sapiens
  misc_feature: GYAE6OF02IDIHH.34.34.D01.1.454.CMB.1.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (434)..(434): a, c, t, g, unknown or other
  misc_feature (434)..(434): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctactctggcctcccagacaccactaggagaaatagtgatgacgcagtctccagcccaccctgtctgtgtctcgaaggggaanacgcccaccctctccgtgcagggccaagtcagagtgtgganagcaacttagccttaggaccagacaagaaccgtgaccaggctacccaagcgttccanagtctagtcgacaacnctaccacgacggcactgacttatccgagtccgtaaggttcagggtgacgtaggtcggtagtacgggactagtacgttccacgtctacccgaactagtcagtaccacgtacccgtnaccgtagtaaccgtagtaaactacctttacgagttaacctttaacgtttttaacacgttacgttaagaccgttacgaacgttttaacgtaaaggttaacggttccggtccgggttaacggtaaccgtttacccgggaaacgaaccggggttaacgtaacggggttaaaggaaacctttaaaccggaaacggttaacgtcgggtacggtaccgttacggaaccttaaccggtacttccggtttaaccg

SEQ ID NO: 103682 - DNA, 672 bp, Homo sapiens
  misc_feature: GYAE6OF02HGLDA.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctcgaggggaaancgcccacctctcctgcaggccagtcagagtgtggcagcaacttagcctggtaccagacaacgaaaccgtggccaaggcctacccgagacgtcctcaactctaatgacttaccactccaccgacgggccaactcgacttaacttccgaacgtccaaggtttccaaggttcggaccgtaaggggtttcggggtctacgggggaacaaggttacgttccaacgttctccgaaacgtactacgacgaccagcccttagcgtacggttctaacggtaaattacgttcgttacgaacctttagttttaattaccgtgggttaacaacggtacgtaacgtttaacgtaaagttacgggtcgggtaaccggtaggtaaccggttcgaaaccggaacgggtacggtaaaagggtcgaaaacgttaaccgaaaacggtaccgttaggtacggccgttaagccctaaacggacttcgttcg

SEQ ID NO: 103683 - DNA, 715 bp, Homo sapiens
  misc_feature: GYAE6OF02HFP04.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgcccaccctctcctgcgacgggccagtcagagtgttagcggctacttagcctggtaccagcaagaacctggaccaggccctcccgaggtcctcctacatctatgatcgcgtaccaagcggccacgtcggcctactcccgagtccgtaggttccgaggtcgggacgtagggttcgggtacgtcggggacctaggttaccttccgaccttccgtacccaacctactaccgacgaccgacgtacccgtaggaaccgtaccgttaaaagttcgttttacgactttaaagtttactttaccgttagttacgtacgtagtaccggtacgttacgtaaccgtaccgttcccggtaccctttccgttaccggtaccggttcccggtccccgggttaccggggaccgggtaccgggtaaccggtaaccgggtaacggtaaccgggtaaacgtaaaccggttaaacggtaccgttacgggttaccggtaccgttaccggtacctacccgtgttacccgg

SEQ ID NO: 103684 - DNA, 703 bp, Homo sapiens
  misc_feature: GYAE6OF02JB9GM.34.34.D01.1.454.CMB.1.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagaccaccacgtggagaaatgtgatgacgcagtcctaccagcccaccctgtctgtcgtctacgaagggaanacgcccaccgtctctgcgacggcagtcagngtgtgcagctaactcgcctggtacagcaacgaacctgacgacgcctaccgagacgtccacgactcctatcgcctaacnctaccaccgtaacggcctacgtcgaccttacgtaccgacgtaccgttaggttccaagggttccgcggtacgggttcggtacggtacgggtactaacgggtacttaccgtacttcccggtaacctaactacgtacacggcctaacgtcccgttcgacgtacgtgtaacgtaagtacggtagtacggttacttaacgtttacgttactacggttacacggttaatacggttaaagtaaccgttacggtccggttaaccgggtaccgggtaaaccgttacggaacccggaaggtaccggtaaacgggtaaacggttaacttaacccggaaacggtttacgacgggtttacgaacgttaccggaaccggttaacccgtagtcttaaccgg

SEQ ID NO: 103685 - DNA, 684 bp, Homo sapiens
  misc_feature: GYAE6OF02IMM2B.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanacgcccaccctctcctgcagggccagtcagagtgttggcagcaacgttgcctggtaccagcaagaacctggccaggctcccagtacgtcctcatctatgctacactccaaccgcggcctatcgtaccttactacccgagtccgtacggttacaggtcgggacgtagggttacggggttctacgggggtaactacggttacgttacctaccgttacctaccgtaccaatccgaacggtccacggtacctgaccgtagtccgtaaggtaaacgttcttctacgtacttaaacgttttatacctggtaactcgtactagttaacttaaaggtacggttcgggtaccggttacggtaaccggttccggaaaccgtaacgggggtaaccgtttaaggggaaacggtaaaacgtacccggtaaaaaggtttaccgggtaggttaccggtacgttaccggaaccctaccgttacgttccgtttacgg

SEQ ID NO: 103686 - DNA, 648 bp, Homo sapiens
  misc_feature: GYAE6OF02HS37C.34.34.D01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaanagccaccctntcctgcaggccagtcagagtgtggctagcaacttgcctggtaccngacagaacctggccaggctccagacgtcctcatctatgcgtanactccacgagggccacgtgctatccacgccgtagttcagtggactggtacgggtctacggggacacggtacgttaccgacgttactacccgaacctagtaccgaagtccaacgtcccgtgcctaagttccgtacgtaaagtactttacgtacgtaccttaacttttacttacgtacggttacaacgtacctaaggtacttaaagttaaggttccgggaccgttacggggtaccgtttaccgggaccggtaacgggtaacccgtaagggtaacggtaaacgttaaaccggaaaccgttaaacggttggaacggtccgtaacggaccctaaccgttacgttacttaacgg

SEQ ID NO: 103687 - DNA, 523 bp, Homo sapiens
  misc_feature: GYAE6OF02INDKY.34.34.D01.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggctcccagacaccactggagaaatagtgatgacgcagtctccagccaccctgtctgtgtctccagggaaangccacctctcctgcagggccagtcagagtgttggcagcaacttagcctggtaccagcagaaacctggccaggctcccagagtcctcatctatgctacatccaccagggccactgctatccagccaggttcagtggcaggtggtctgggacagagttcactcgtcacatcagcagcctgcagctagaagtnttctgctatttactactgtcagactagtactaagtagtggccgttggtaaccgttcgaccgtagggaccgaacgggtcgaaaacgttccgaaaacgtacgtaggtacgtacgtgaccactacgtctacgg

SEQ ID NO: 103688 - DNA, 816 bp, Homo sapiens
  misc_feature: GYAE6OF02H8WO9.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtcgtcccgaggggaaangccatcctctcctgcacgggccagtcagagtatagcacctaattgcctggtaccagacaagaacctcggaccagacctccgagctcctatatctagtcggtcgacacgtaccaccgagggcccaacgttcggtacctacccgaaggggtccgtaaggtttccgaagggttcggacgttacgggttcgggggttaccttagggggaactaacgggtacgttttaccgaacccgtttccgtaacccgtaaccgtaacgttaccgaacggtccctaaccgggttcgtttacggaccgtttacggtttaacggtaacggttaaacgtttacggttttttacgaaccgttttaaacggtttttaacgtttaccgttagggttaacccaggtaaccttaaaccgtttaaagttaaaccggttacgggttaccggggtacccgttaaccccggttaattttaaccccgtacccggtttaacccggggaaccgtaaaccggggtaacccgtaaccgggtaaaccgtggggaaaaccctttaaaggttaaaacccggtaccgtttagggtaccggtaccgtaaccggtaccttaaacccgtacgggttaccctttaccgg

SEQ ID NO: 103689 - DNA, 695 bp, Homo sapiens
  misc_feature: GYAE6OF02IS751.34.34.D01.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccaccctgtctgtgtctccgaaggggaaancgcccaccctctcctgcgagggccagtcagngtgttgcagcaacttagcctaggtaccagcaagaacctggccagctacccagacgtcctacatcctatcgactacactccgaccgacgggccctagtcgtaccttaacttccacggtccgtaagggtttaccaaggttccggacgtagggtttcggggtacgttaggggaactacgggtacgtttccaaccttcctcgaacctacgttaccgaacgtaccgtacgtcccgtggacctaaggttccgtaagaaacgttctttaccgagttaaccttaacgttttactaacgtcgttaccgagtactacggtttaactaaacgttaggtcggtaccggttacggtaaccggttacggaaccggtaacgggaaccgttaacgggtaacggaaaccgttaaccggaaaacggttacgtagggttcggtaccctaggtaacccgtacttacgtaccgtttccg

SEQ ID NO: 103690 - DNA, 627 bp, Homo sapiens
  misc_feature: GYAE6OF02I016X.34.34.D01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (614)..(614): a, c, t, g, unknown or other
  misc_feature (614)..(614): n is a, c, g, or t
tcagtacacgtgatcacgaccggtgctcgatttagatcgtctgtgttggggtttgggggaggaactgctcagttaggacccagacggaaccatggaagccccagcgcagcttctctttcctcctgctactctggctcccagacaccactggagaaatagtgatgacgcagtctccagccaccctgtctgtgtctccgaggggaaacngcccaccctntccngcagggccagtcaagngtgtggcagcaacttgcctggtacancgtagaaaccctggccaggcctcccgagacgtccctnaatctattgactacatcccacgagggcccatgctacttccagccaggttccaagtggcgagttggtctggggacagtagtttccagtcctacacctatcgaagtccacggccttgacgaacgttcgtacgaaagtctttacngtactaaacctttttagtaacnggtttacaanctaagtaccttaaagttacgtacgggttcggtacggtaaccggtttccgaccgaacggggtaacctaaaagggttcggaaaacgttaacggaaaaccgtaacgttaccgggtaggaccgttaggacccctaaacccgttntacccgtttacgg

SEQ ID NO: 103691 - DNA, 770 bp, Homo sapiens
  misc_feature: GYAE6OF02HF5KX.34.34.D01.1.454.CMB.1.raw
  modified_base (206)..(206): a, c, t, g, unknown or other
  misc_feature (206)..(206): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggaagaaatgtgatgacgcagtctccacgcccacctgtctgtcgtctccgagggaaancgccaccctctcctgcgagggccagtcagtagtgttggacagactaactcgccgttaggaccagaccaagaaccgtcggaccgacggtcccaccgagtacgtcctactacttctactcgtacctaccactaccgtaaccgacggtaccacgtgtaccttactcccgacgtccgtaggttaccaggtcggtacgtgggttagggttcgtacggggtactaggtaccgttacctaccgttacctaccgtaaccacgtaccgacggaccgtaccggccttacggtaccgtacggttacgttaacggtaacttaccggtttacgtaccttaaccgtttaaactttttaccgttaccggttacgttaccgtaacgttaccgttaacgtttaacgtttaacggttaacgggttccgggttaccggggtttaacggtacccggggtttaccggaaccgggtacggggttaaccgggtaacgggttaaacgggttaaaccgtaaacggtaaaccggttacggttacggtaccggttacgtaccgtaacgtaccgtttacgtaccgtttaccg

SEQ ID NO: 103692 - DNA, 749 bp, Homo sapiens
  misc_feature: GYAE6OF02G4WU9.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccacgtggagtaaatagtgatgacgcagtctccagccacctgtctgtcgtctcgaggggaancgccacctctcgtgcagggccagtcagtagtgtgcaggacaacttcgccttaggtaccagccaacggtaaaccgtggaccgtaggcccttaccgaggtctcctatactctagtcgtacctacactcccgacgacggccctagtcgtacttacctccgacgtccgtaggttccgtagggtcggtacgtcgggttaggtcccggtagggactacgggttactcgaacctctaccgactagtaccgcggtacgacgtccgtacgtaccgtacgttacggtacgaaacgttccttacgtacggtttaacctttaccggttttaacttccgttacggtacccgaacggtttacctaacggttttaccgggttaaaaccgtcgggttacggggttaccccggttaaaggtacccgggttaccgggtaaacggtacgggggtaaacccgttaaaggggttaaccgtaaaaccggttaccgttaaaaccggtacgggtttcggtaacgggtacccttaccggtaaccggtacgttaaccggttccgttaaccg

SEQ ID NO: 103693 - DNA, 657 bp, Homo sapiens
  misc_feature: GYAE6OF02HX2UM.34.34.D01.1.454.CMB.1.raw
tcagtacacgtgatcacgaccggtgctcgatttagatcgtctgtgttgggtttggggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaacgcgccaccctctcctgcagggccagtcagagtgtggcagcaacttacgcctggtaccagacaagaaaccgtcggaccacggcctcccaggacgtcctacgatctatcgctacactccgacgacggccacgtgactacttccacgctaggtcagtcggacaggtcggtcgtacgggactaggtagttcctacctcgtccaaccgtatccgaagtcacgtcctaggctacgtacgtaggtaacgtatttcgtagtaccttactttttaactacgtacgttacgaacgtacttacgttacttaaaggttacgggtcggtaccgggttaggtaacccggttcgggaacccgtaacggggaaccgtaaggggtaaccggtaaagttaaacccggaaacgttaacggtcggttacggtacccgtaacgtaccccgtaaccgttacgttaccgttaccgg

SEQ ID NO: 103694 - DNA, 582 bp, Homo sapiens
  misc_feature: GYAE6OF02HCJ8T.34.34.D01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttagcagcaattggcctggtaccagcaagaacctggccaggctccgaggcctcgtcagtctagtggtncatccgaccagggccagtcggtactcccgagccaggttcaggtggcaggttgggtctaggggactagtactttccactctacaccatcacgcacgcctgcagtcgtagtaagtagtttcgacgtagttcgttaattactacgtactaagtagttacgtactaccacgtacgtacgtcggtacgttccggaccgaacgggaccgtaagggtacggtaaacgtaaccgtaaacgaacgttacggacggtaccgtacgacctaccgtacgttcgttacgttcc

SEQ ID NO: 103695 - DNA, 729 bp, Homo sapiens
  misc_feature: GYAE6OF02IKXK2.34.34.D01.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatgtgatgacgcagtctccagccaccctgtctgtgtctccgaggggaaancgccacccttctcctgcgagggccagtcagagtgttggcagcaacttagcctggtaccagcagaaacctggccaggcctccgagacgtcctnatctatgctacactccacgaggcctacgtgcttactccagcctaggttccagttcggacgtaggttcgggtcgtacggggactaggtacgtttccgaacctttctccgaacctacgttaccgaacgtccgaacggtcccgttacggacgtacggttacgtaacggtaaacgttaccgttttccgtacggttaccctttaaacgttttttaacttaccggttacggttaccgtaacggttaccgttaagtttaaccgttaaaacggtttaacgggtccggggttaacccgttcgggggttaaaccggtttcccgggaaccggtaacggggtaaccggtaaacggggttacggtaaaaacgtacccggtaaaacggttaaccgttaggggttacccggtacttaccgggacctaccggtttacttcgtttacccgg

SEQ ID NO: 103696 - DNA, 660 bp, Homo sapiens
  misc_feature: GYAE6OF02GPJR6.34.34.D01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctntcctgcagggccagtcagagtgtggcagcaacttgcctggtaccagcagaacctggccaggctccagacgtcctcatctatgactacactccaccacgggcccactgcctacttccagtccaggtttcaggtggcaggtggtctgggacagtacgttcactcctcaccgtatcccgagtccgacgtcccgtgaccgtaggttaccctaggaaacgttacgtttaccgtcggttaccttaaccgtttttactttaaccgtttcgtaaccgtacggtaccttaaaggtttaacttaaacgttaaccggttcggtaccccggttacggggtaccggtttaccggaccggtaacgggtaaccgtaagggtaacgggtaaacttaaccgggaaaccgtaacggttacggtacggtaccgttacggacccttaaccgtacgttaccgttaccgg

SEQ ID NO: 103697 - DNA, 619 bp, Homo sapiens
  misc_feature: GYAE6OF02IDKPK.34.34.D01.1.454.CMB.1.raw
  modified_base (113)..(113): a, c, t, g, unknown or other
  misc_feature (113)..(113): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
  modified_base (594)..(594): a, c, t, g, unknown or other
  misc_feature (594)..(594): n is a, c, g, or t
tcagtacacgtgatcacgaccggtgctcgatttagatcgtctgtgttgggtttgggggaggaactgctcagttaggacccagacggaaccatggaagccccagcgcagcttcncttccccctgctactctggctcccagacaccactggagaaatagtgatgacgcagtctccagccaccctgtctgtgtactccaggggaaanagccaccctntcctggcagggccagtcagagtgtggcagcaacgttagcctgtaccgagacaggaaacctggccaaggcctcccagacgtcctcatctangtctacacttccaccagggcctactcgcttaattccaacggccacgggttacaggtcggactaggttcgggtcgtacgggtacaacgaagtttccgactcgttaccacctatacgacgacctagcctacgtgaaccgttgtacaacggttaacttcgttagtaccgttactttttacgtactttaacgcgtacgtacgtacggttacctaaagttacggtcggtaccgttcggtaacgttcggtacgacggaccgaaggtcggaacgtacaacggtatacggtaggtacncgtaactcgaacgtttagtcgttac

SEQ ID NO: 103698 - DNA, 589 bp, Homo sapiens
  misc_feature: GYAE6OF02GGCSO.34.34.D01.1.454.CMB.1.raw
  modified_base (205)..(205): a, c, t, g, unknown or other
  misc_feature (205)..(205): n is a, c, g, or t
  modified_base (352)..(352): a, c, t, g, unknown or other
  misc_feature (352)..(352): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangcccaccctctcctgcagggccagtcaggtagtgttggcagctaacttgcctggtaccagcaacgaaacctggccaggccctccagacgtcctcatctatgctacactccacgacggcctactgactactccagtcctaggttaccngtcggactgggtcggtcgtagggactagtagttccactcacacctatacagctacgcctagctagtcgtagaagttcttcgagtacttacttttacgtactcgctacgactagtaactaagtacgggtcggtaccgttaggtaccgttccggaacggtacgggaacctaaggggtaacgtaaactaccgaaacggtacgttggacgtactacggaacctaccggtatccggttaacg

SEQ ID NO: 103699 - DNA, 864 bp, Homo sapiens
  misc_feature: GYAE6OF02HUPOO.34.34.D01.1.454.CMB.1.raw
  modified_base (207)..(207): a, c, t, g, unknown or other
  misc_feature (207)..(207): n is a, c, g, or t
tcagtacacgtgatcacgaccggtgctcgatttagatcgtctgtgttgggtttggggagaactgctcagttaggacccagacggaaccatggaagccccagcgcagcttctcttcctcctgctactctggacctcccagaccaccactggaagaaatagtgatgacgcagtctccagccacctgtctgtcgtctacgaggggaaacncgcccacccgtctaccgtgacgagggcccagtccaggtagttgttacggctacgactaaacgtttacgccgttaggtaacccaggaccaaacggtaaaccgttcgggacccacgggtaccctaccccgaggtaccgttccctactacttaccgttaacgtccgtacctaaccgtaccttaccccgaaccgtaacgggtcccctaacgttcggtaccttaacgttcccgaacgtcccggtaggttaccgaggtcggctaacgggtcggttacgtacgggtaacctaggtacgtttaccgaccgtttaccgaccgtaaccgtagtaccgtaacgtccgtaaccggtaccctacggacgttacggtaccgttaacggttaaaccgtctttaaccggttcgtaccgtttaaccgttttagttaccgtacggttaccgtaacgttaaccgttaacggttaacctttaaacggttaaccgggttaccgggtacccgggttaaaggttaccccgggttaacccggggtaacggtaacccggggttaaccggtaaacgggttaaacggtaaaccggttaaacccgtaaaccggtaaccggtttacgggtaaccggtaccgttaccggttaacccgtaaccgttacccgtttacgtttaaccccgg

SEQ ID NO: 103700 - DNA, 543 bp, Homo sapiens
  misc_feature: GYAE6OF02GZSFV.34.34.D01.1.454.CMB.1.raw
  modified_base (204)..(204): a, c, t, g, unknown or other
  misc_feature (204)..(204): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (500)..(500): a, c, t, g, unknown or other
  misc_feature (500)..(500): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccagggggaaancgccaccctctcctgcagggccagtcagagtgttggcagcaacttgcctggtaccagcagaaacctggccaggcctcccagacgtcctcactctatcgactacactccaccacgggccactgctattccagccaggttcagtcggcaggtcgggtcgtgggactagnggttcacgtctaccacatcagcagcctcgctagtctagaatnttctancttaactttcttactcgtcagactagtactaatacgtcgtcgtaggtacgttcggaccgtacggacgtaggtacggtaaanacgtaaacgtacgtggtacggtctacgactacgtactcgtacg

SEQ ID NO: 103701 - DNA, 695 bp, Homo sapiens
  misc_feature: GYAE6OF02HJDB4.34.34.D01.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactgganaaatgtgatgacgcagtctccagccacctgtctgtcgtctccgaggggaaangcccacctctcctgcagggccagtcagagttgtggcagcaacttagcctgtaccagacacgaacgtgaccaggcctaccgaggtctcctctacttcgttggtcgtccgtccaccgacgggtcccaacgttcggaccactcccgagtacgtaggttcaggtcggcgtaggtgggtactgggactagtaccttcactcctactactatacgacgtctacggtacgttgaccgtcgttaagtaacgttacgttttacgacgttaagttaacgttactttacgtaggttacctaacgttaccgtaaagttaacgtaccggtaacgtaccgacgtttacgtcgggttaacgggttcccggttacgggaacccggttaaacggggaccggttaaaggggttaaaccggtaaaccgtaaaccgggaaaacgttaaccgttacgggtaccggtaccgttacggtaaccctaaccggttacggtttactacggtttacccg

SEQ ID NO: 103702 - DNA, 652 bp, Homo sapiens
  misc_feature: GYAE6OF02JRQOT.34.34.D01.1.454.CMB.1.raw
  modified_base (177)..(177): a, c, t, g, unknown or other
  misc_feature (177)..(177): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagtacacgtgatcacgaccggtgctcgatttagatcgtctgtgttgggtttgggggtagggaacgtgctcagttaggacccagacggaaccatggaagccccagcgcagcttctcttcctcctgctactctggctcccagacaccactggagaaatagtgatgacgtcagttccnccacgcccaccctgttctgtcgtctccgagggaacngcccaccctntcctgcaggccagtcagagtgtcggacngactaatcgctacggacancgaanaaccgtggcccaggccctccgacggtatccctntactgtactcgacctanactcccacgcggtaccgtactcgcttacgttccaggaccgtagttcgacgttggacgtggtggtccgagggtaccaggtataccctgtcctaacncctagtaccngcctacgtccgttacgaccgtatacgtacggtatttacgtcctttacgtaacctttactttaacgttccgtagtacgtactacgttaaccttagttaacgtaaccggttcgacggtccgggtactaccggggtaacgacgtaaccggtaacgggtcgtaaacgtacgtaaaccggtacgtcgtacgggtaactcctaaccggacttacccggtattacccgg

SEQ ID NO: 103703 - DNA, 633 bp, Homo sapiens
  misc_feature: GYAE6OF02H1QLB.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctcgaggggaaanagccaccctctctgcagggccagtcaggagtgttggcagcaacttagcctggtaccagcaagaacctggccaggcctacccgagacgtcctcactctatcgccttaacacttccaaccgacgggacccactggtaccttacttcccagcctaaggttccaaggtcgggactacgggttcgggttacgtaggggacctaggtacgtttcccaacgttcttaccgaacctagtcgaacgacctaacggccctacgcgtaacgttacgtaggaaacgtagtttccgtagtaccttaatttttactacgtcggtacaacggtctaacgttacttaaagtacggtcgtccggtaggtacccgtcggacgaagggtaccgaagggtataacgacaaaccggtaacgtggtcggactcgacctactacgttactcgg

SEQ ID NO: 103704 - DNA, 694 bp, Homo sapiens
  misc_feature: GYAE6OF02FHBVJ.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaanacgccaccctctcctgccgtagggccagtcagagtgttggcagctaacgttagccgtggtaccagcacgaacctggccaggcctcccgagtacgtcctcatctatgactacactccacgacgggcctacgtgccttacttaccacggtacctaggttctaggtcggtaccgtagggtgggtccgtgggaactaggtacgtttaccaccttctacccgaaccctagttccgaacggccctaaccggtcccgttaggacccgttacggttacccgtaacgggaaacgttactttccggtacgtaccgttttaacttttacgtttaccgttccggtacgtacggtaccgtagttaccgttaaagtaaccgggttcgggaccggttacggtaccgtttaccgggaaccggtacggggaaccgtaacgggtaaggaaacctaaccggtaaaacgtagttcggtacggacttaccgacctaacctagttacgttaccg

SEQ ID NO: 103705 - DNA, 581 bp, Homo sapiens
  misc_feature: GYAE6OF02GZ432.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagccctggtaccagcagaaacctggccaggcctcccagagtcctcatctatgctacatccaccagggccacgtgctattccagccaggttcagtcggcagtgggtctgggacagtacgtcactctcaccatcagcagcctgcagtctgagtattctgtcctacttttacttactcgtcaggtctagtacttaaagttaacggttcggtacccggttagggtaacccgtttccggggaccctaacgggggtacccgaaggggttacggaaaacttaccgaaaacgggtaccgttggtacggtaccggtagacccgtaacgtacgtccgtttaccg

SEQ ID NO: 103706 - DNA, 792 bp, Homo sapiens
  misc_feature: GYAE6OF02JBR8M.34.34.D01.1.454.CMB.1.raw
  modified_base (153)..(153): a, c, t, g, unknown or other
  misc_feature (153)..(153): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggaanaatagtgatgacgcacgtctccagccaccctgtctgtgtctccgaggggaaagcgcccaccctctccgtgcgcgggccagtcagtagtggtggcagcaacttgccgtaggtaccagaccaacgaaacccgtcggaccgacggtaccctacccgaaggaccgtccctactacttcacgttcgacctaaccacctaccccgaacccggtcggggaccccttaacgtacccgttaccgttaaactttaccccgaacggtacccgttacgggtttacgacgggttacggaccgggttagggtttcgggggttacggtaacgggggaaccgtaaggttaccggtttcctaacccgttacccggtaccctaccacgtaccgacggtaccgacctaccgtcggtactacgttacgtaacgtaacgttccgttactacgtttacctttaacgtttacgtttaccgacgtttcgaacgttacgtacgtttaaccgttaaggttacgtccggggttaggttaccggtaaccggttaccgggaaccgtaagggtaccggtaacggttaaacggtaaaccgaacggtaaaaccggttcggttaacgggtacggtaccgttaccggaacgtacccgttcgtttacgttaccg

SEQ ID NO: 103707 - DNA, 676 bp, Homo sapiens
  misc_feature: GYAE6OF02IOD2V.34.34.D01.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (471)..(471): a, c, t, g, unknown or other
  misc_feature (471)..(471): n is a, c, g, or t
tcagtacacgtgatcacgaccggtgctcgatttagatcgtctgtgttgggtttgggggtagggaacgtgctcagttaggacccagacggaaccatggaagccccagcgcagcttctcttcctcctgctactctgctccagacaccacgtggagaaatagtgatgacgcagtctcagcctaccctgtctgtgtctacgaggggaaancgccaccctcncctgacgtacgggccagtcagtagtgttacggcagctaacttcggcttcggtaaccagaccaacgaaaccgtcggaccacggtctacccgaggacgttccctacgagttactagtcggtcctaactacgtacccaaccggaggggcctaactgtctacgttaccacggtcctaggttacncggtcgtgacggtttgggcctagggacctagngttaccagttcncaacgtnactacgctacgctggcacggttnagtacgtacttacgtcgtacgttaactttaacgttagtcgttacgaacgttagtaccgttaaagttaaaacgttccggttagggccgggttacgggttaacgtaccggggtaactaccgggggtaagtaccgggtaaaggttaacgttaaccgaaacggttacgttcgggacgttcgtaccggaacttaccgtagttaccgttcg

SEQ ID NO: 103708 - DNA, 605 bp, Homo sapiens
  misc_feature: GYAE6OF02IFHKG.34.34.D01.1.454.CMB.1.raw
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagtacacgtgatcacgaccggtgctcgatttagatcgtctgtgttgggtttgggggaggaactgctcagttaggacccagacggaaccatggaagccccagcgcagcttctcttctcctgctactctggctcccagacaccactggagaaatagtgatgacgcagtctccagccaccctgtctgtgtctccgaggggaagcgccacctctcctgcagggccagtcagngtgttggcagcaacttagcctaggtccagacagaaacctggccaggcctcccgagaacgtcctcactcttatcgtactacnctacccaccgacggccacgtgaccttattccgacgccgtaggttcaggtggtacgtggttcgggtacgtcgggactaacggtgttaccacgtcctccgaacctgtcccgagccgacgtacctggctacgtacgtgaaacgttatttctgtaccttacttttagtctagtcagtaccttagtactaaggttacgtggtaccgtcggttccgtacggacggtaacgggtaaccgtaagggtaacgaaacctaggaaaccgtactaggtacggtactcgacctacgtacgtcttacg

SEQ ID NO: 103709 - DNA, 658 bp, Homo sapiens
  misc_feature: GYAE6OF02HZCL8.34.34.D01.1.454.CMB.1.raw
  modified_base (504)..(504): a, c, t, g, unknown or other
  misc_feature (504)..(504): n is a, c, g, or t
  modified_base (526)..(526): a, c, t, g, unknown or other
  misc_feature (526)..(526): n is a, c, g, or t
  modified_base (548)..(548): a, c, t, g, unknown or other
  misc_feature (548)..(548): n is a, c, g, or t
  modified_base (559)..(559): a, c, t, g, unknown or other
  misc_feature (559)..(559): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagcccaccctgtctagtcgtctaccgaagggggaaacacgcccaccctctacctgcgagggccagtcagagttgtggcagacctaagttacgccttggtaacccagacaacggaaaacctcgggacctaacgggtccctacccgaggtacgttacccctgaacttctaagtcgactaccactcccaaccgtcgggacccacgtagtccttaacgttcccgaaggtcctaacgggttcctaggtcgggtaccgtaaggggtttcgggtacgtagggggaacctagttaacggttcctaacgtcctaacctaccgatcgacgtaccgagtcccnggtacctagtactaggaacttntcgagtacttatttactacgtntacataccgtntaagtaagtgtacgtcggtagtaccgtacgggtaccagggtactaagggactaaacgtacgtaaatacgtgtacgaccgtacgactacctactcgttac

SEQ ID NO: 103710 - DNA, 732 bp, Homo sapiens
  misc_feature: GYAE6OF02IUHVD.34.34.D01.1.454.CMB.1.raw
  modified_base (209)..(209): a, c, t, g, unknown or other
  misc_feature (209)..(209): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctccagacaccactggaagaaatagtgatgacgcagtctccagcccaccctgtctgtgtctaccggaaggggaaancgccctacctctcctgcacgggccagtcaggtagtggttggcacgctaaacgttcgccgtaggtaaccagaccgaacgtaaacccgtggaccacgggccctacccgaggtacgtaccctactaacgtctaacgtcgtacctaaccgtactcccgaccgacgggccctacgtctccttactccgagccgtaggttacgaggtcggaccgtaggttcgggtacgtacgggaactagggtaccgttaccacgtttccactaccgtacggtcctaacggccgtaacggtccggtagtaccgtaacggtcgtaggtaaacgttactttcgagttaacccttttaacttttacgtttaccgacggtacgttacgacgtttaacggttaacttaaaacggttcgggttccggtacggtccggggtaacgtaccgggtaaccggaacggtaacggtaagggtaacgtaaaccgttaacggaaaccggttcgttaggtaccgtaccgtacggaacctaccttagtcttaccg

SEQ ID NO: 103711 - DNA, 609 bp, Homo sapiens
  misc_feature: GYAE6OF02HBQG9.34.34.D01.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctcagccaccctgtctgtgtctccgaggggaaanacgccaccctctcctgcgagggccagtcagagtgttggcagcaacttgcctggtaccagcacgaaacctggaccaggcctaccagacgtcctcatctatcgctacntccacgcggaccacgtcgcttactccagtcctaggttcaggtcggcgtaggttgggtcgtgggactacggtacgttcaccttcgtacaaccgtatcgacgctacgcccgtagctaggtctacgaagtcttacgtcgaccttacgtttacttactgttaccagttactagttactaaagttacggtcgggtaccggttggtaccgttccggaccgtacgggaccgtaagggtaacggaaacttaccggaaacggtaccgttggtacgggtacctacgacccgtacgtcgttccgttaccgg

SEQ ID NO: 103712 - DNA, 673 bp, Homo sapiens
  misc_feature: GYAE6OF02HL21I.34.34.D01.1.454.CMB.1.raw
  modified_base (204)..(204): a, c, t, g, unknown or other
  misc_feature (204)..(204): n is a, c, g, or t
  modified_base (329)..(329): a, c, t, g, unknown or other
  misc_feature (329)..(329): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccacgtgtctgtgtctcgaaggggaaagngtccacccttctacctgcgacgggccagccaggtagtgttacgcacgctaacgttcggccgtaggtaccagacaacggaaaccgtcggaccacggcctcccgacggtcctacctcaatctatggnctactccaccgacgggccacgtcggtacctccgagaccgtaggttcgacggtggacgtgggtcggtcggtacggacaagtaacttcactctacaaccctatacgacgcacgtccgtgaccgtagtcgttaagtattcgttttagacttttagtttaacttcgttgtactgtataagtttaaactaacgtaccggttacggtacccggtttacgggtacccggttacggaaccgtaacggggtaccgtagggttaacgtaaccggttaacgaaacggttaccgtagggtacccgtacgttacggacccttaacgtacgttccgtttacggttaccctttaaccgg

SEQ ID NO: 103713 - DNA, 644 bp, Homo sapiens
  misc_feature: GYAE6OF02HWLG6.34.34.D01.1.454.CMB.1.raw
  modified_base (206)..(206): a, c, t, g, unknown or other
  misc_feature (206)..(206): n is a, c, g, or t
  modified_base (619)..(619): a, c, t, g, unknown or other
  misc_feature (619)..(619): n is a, c, g, or t
tcagtacacgtgatcacgaccggtgctcgatttagatcgtctgtgttgggtttggggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagngccaccctctcctgcacgggccagtcaggagtgttggcagcaacttacgcctaggtaccagacaacgaaaccgtcggaccacggtcctacccgagtacgtcctcatctagtcactacactccaaccgacggacccacgtgtactaactccgacgaccgtacggttcgaggtcggacgtagggtcgggtacgtcggggaacgtaggtacgtttccgacttccgtaccacctactaccgacgaccgacgtcctcggacgttaaggtcctaaggtaaacgtctttccgagttaccttaattttacgttactacggtatacggtatacgttaactaagtaaggtcggtaccgtaggtaccggttcgggaaccgacggggtaaccaagggtacgaaacctacggaaactacgttcggngtacctgaccctaactcgtcttccg

SEQ ID NO: 103714 - DNA, 679 bp, Homo sapiens
  misc_feature: GYAE6OF02JA25R.34.34.D01.1.454.CMB.1.raw
  modified_base (202)..(202): a, c, t, g, unknown or other
  misc_feature (202)..(202): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaancgccaccctctcctgcgagggccagtcaggagtgttcggcagactaacttcgccgtggtaccagcaagtaaaccgtggccaggcctccagacgtcctacgatctatgactactactaccaccacgggcctacgtgactacttccacgccgtaggttacgagtggcgtaggtcgggtcgttaggggactaggtacgttcgacttctaccaccgatacgacgtcaacggtcctggacctacgttacgtacggaaattcgtttacacggttacttaaccttttaacgttactcggttacgtacgtaccgtaagttaccttaaagttacgggtacgggttacccggtacgggtaccggttaccggaaccgggtaacggggtaaccgtaaacggggttaggtaaaaccgtaaccgtaaaacgggtaccgttaagggtcgggtaccgttacgaaccggtacccgtacgttaccgtttaaccgg

SEQ ID NO: 103715 - DNA, 630 bp, Homo sapiens
  misc_feature: GYAE6OF02GK3RE.34.34.D01.1.454.CMB.1.raw
  modified_base (205)..(205): a, c, t, g, unknown or other
  misc_feature (205)..(205): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangccacctctctgcagggccagtcagagtgttggcagcaacttgcctggtacagcagaacctggccaggctcccagacgtcctcatcgtatgcctacactaccaccgacgggccactcgctattcccagccaggttcagtgccagtcggtctggacngacgttcactctacacatcagtcacgtccctagaccagtacgtagaaacgtnttacgttcgacttacttttaattacttcggtactacggccgtaacgttacgttaaagttaacggttccggtacccggttacgggtaacccgtttaccgggacccgtaaacggggtaacccgttaaaggggttaaccggaaaacgtttaccgaaaaacccggttaacgttacggttacggtacgttaccggaccctaaccgttactccgttaacccgg

SEQ ID NO: 103716 - DNA, 696 bp, Homo sapiens
  misc_feature: GYAE6OF02HCZPT.34.34.D01.1.454.CMB.1.raw
  modified_base (530)..(530): a, c, t, g, unknown or other
  misc_feature (530)..(530): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgcctactctggcctcccagaccaccactggagaaatagtgatgaccgcagtctccagcccaccctgtctgtcgtctccgagggaaacgcgcccacccctctcctggacgacgggtcccagtcaggtacgtgttggcacgtcaaacttgccgtcggtaccagacctaagaaccgtggaccagggcctcccgagtccgtcctacactctatcgactacactaccacgtacggacctactgtacttacgtccacgtacctaggtcagtcggtacacggttcggtcgtacgggtactacgtcgttaccaccgtctacccgacgtaacgtccgacgtccgtacggtccgtacgtacgtacgttccgtaaggtacgtacttacgtacggtaccttaacttttagtacgtccttanaccggtacttacgttacgtaaacggttacgggttcgtaccgggttacggttacgggtacccggaaccgggtaaccgggtacggaacgggtaacggaaaccttacggtaaaacccggtaccggtagttaccggtcgtaccgtaccgtaacctacggttcttacccgg

SEQ ID NO: 103717 - DNA, 1006 bp, Homo sapiens
  misc_feature: GYAE6OF02JK6K2.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtcgtctccgaggggaaancgccaccctctcctgaccgagggcctagtcaggtaggttcgtttgggaccaggacctaaacgttttacggcccgttacggggttaacccacgggtaccaaacgggttaaaaaccccgttccggggaccccgaaggggtcccctttaccccccgaaacgggtacggtttcccccttaaccaacggtttccttaacgttcggtaccctttaaccggaactttacccccgaaccccggaacgggggtacccctaaccgttcggtaccgttttaacctttaccccgaaacgggtccccgtacgggttttcccggaaaccggggtttcggggaccgttaacggggttttcggggttacccggtacggggggtaaaccctagggttaaccggttttaccaacccggtttacccttaccgaaccctaacggtttacccgacgggacccgttacggaccccgttaggtacccgttaggttaaccgtcgggtaaaacgttacgttttcccggtaccgttaaccgtttaaccgtttttaaaccgtttccctttacggggttacccaaacggggttacccttaaacggggtttaaccctttaaaaacgttacgggggttccggtttacccgggttaacgggggtttaaccccggtttacccggggaaccggttaaccgggggtaaaccggttaaagggggttaaacgggtaaaccgtttaaaccgggtaaaaacccgggtaacggtttaacgggttcccgggttaccgtaccggggttaaccccaaccggtttaccgttaccgtttaaccgg

SEQ ID NO: 103718 - DNA, 619 bp, Homo sapiens
  misc_feature: GYAE6OF02HEBPB.34.34.D01.1.454.CMB.1.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaanacgccaccctctcctgcgagggccaggtcagagtgttggcagctaacgttagcctaggtaccagcaaggaacctggccaggcctaccgaggcctcctcatctagtcggtcactacgtaccaccgcgggtccacggttggtacctcccgagtccgtaggttcaggtcggctagggtcgggtcagggacagtacttcactcncacntcagcacgctacgctagtctagtaagttctttgacttttaagtttacttagtcgttacagtacgtaagttaactaacgtaccggtccgggtccggttaccggggtcggttaccggaaccgtaacgggacggtaacgggttacgtaacgttaccggaaacgtacggtcggtacggtacgtacgacccgtactacgttacgttcttaccgtaccg

SEQ ID NO: 103719 - DNA, 340 bp, Homo sapiens
  misc_feature: GYAE6OF02H0BIV.34.34.D01.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (272)..(340): a, c, t, g, unknown or other
  misc_feature (272)..(340): n is a, c, g, or t
tcagtacacgtgatcacgaccggtgctcgatttagatcgtctgtgttgggtctgggacagagttcactctcaccatcagcagcctgcagtctgaagatttctgctacttttattactgtcagcagtctaaataagtgccgtggacgttcggccaagggccaaggtgaaatcaaacgatgtggctgcaccntctntcttcatctacccgcatctagaatcagtnactgagcgggctaggacaaggcanagtaagacgtnagntncntactngnnnnnnnnnnnnnnnnnnnnnnnnnnnnnnnnnnnnnnnnnnnnnnnnnnnnnnnnnnnnnnnnnnnnn

SEQ ID NO: 103720 - DNA, 806 bp, Homo sapiens
  misc_feature: GYAE6OF02G25AH.34.34.D01.1.454.CMB.1.raw
  modified_base (214)..(214): a, c, t, g, unknown or other
  misc_feature (214)..(214): n is a, c, g, or t
  modified_base (601)..(601): a, c, t, g, unknown or other
  misc_feature (601)..(601): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccacgccctaccctgtcctgtcgtctaccggaaggggaaacncgcccaccctctaccgtgaccgacgggcctagcaggtacggttgtcggaccaggctaaccgttcgccgttacgggtaaccagaccgaaacgtaaccgttcgggaccacgggtaccctacccggtaagtaccgttaccctactagttaccttacgtacgtacctaacctaccgttaccccgaaccgtcgggaccttaccgtcgtaccttactccgaccgtcggttacgtacggtaggttcggacgtacgggttcgggtacgtaaggacgtaacggttcttaccgtaaccgttcctaccgacgtagtaccgaacggtccaccggtctacgacgtacgttcgaaaggtacttcgttaccggtacttcctttaaacgtttttacgtaccgngttaccgtacttaacccgtaagtttaccgttaaacgggttacgggttcccgtaaccggggtttacggtaacccgggttaccgggtaaaccgggaaccggggtaacccgttaaaggggtaacgtaaacctttaacgggaaaccggttaccgggttccgtttaacgggctaaccgtaacccttaacggtaccctttaggttaacccc

SEQ ID NO: 103721 - DNA, 745 bp, Homo sapiens
  misc_feature: GYAE6OF02JR0XX.34.34.D01.1.454.CMB.1.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (546)..(546): a, c, t, g, unknown or other
  misc_feature (546)..(546): n is a, c, g, or t
tcagtacacgtgatcacgaccggtgctcgatttagatcgtctgtgttgggtttgggggagggaacgtgctcagttaggaccagacggaaccatggaagccccagcgcagcttctcttcctcctgctactctggctccgagacaccactggagaaatagtgatgacgcagtctccagccaccctgtctgtntctccgagggaagngccaccgtcctctgcgacgggccaggtcaggaagttggttacggctacggacctaacgttacgtacccgttacgggttaaccccaggaccgtaagtaaaacccggttccggacccggtaacgggtcccctaacccggtaaggtccggttacctaccgacgtttctaagttaccggtaccttacgtaaccttccccgaacccgtacgggacccgtacgtaacggtccttaacgttcccgaaacgggttacccgtacggtttaacgttacgggcggtaacgtacggggtttcgggtacggtcgggaacctaggttactaccgtccttaccacgtactacgtacnggacacgtcgtacgtagtccgtatacgtacgtacgttcgtcgtactactttacgtactcgctacgtatacgtacttacgtaacggtgtccggttagtacggtttaccgaccgggttacgtaacggtacgggttaacgtaagtaacccgtaaggtaccgttggttaacgcgttacgtaccgaccggtacttaccgtaccg

SEQ ID NO: 103722 - DNA, 764 bp, Homo sapiens
  misc_feature: GYAE6OF02GJEY7.34.34.D01.1.454.CMB.1.raw
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccaccctgtctgtcgtctccgagggggaaagacgcccaccctcctcctggccgagggtccagtcaggagttggttggcaggctaacttacgcctggtaccagcaacggaaacctggaccaggccctaccgagtacgtcctnatctagcgtactacactccacgcggaccacgtcgacttacttccgagtcccgtaggttccgaggtcggtacaggtttcggggtacgtacggggtaacnggttaaccgtttccacccgttctaacccgacctaacgtaccgtacggaccgacggtcccgtcggtacgtaacggttaccgtaaggtaacgttacgttttaccgtcggttaccttttaacgttttaacgtttaaccgttacggttacctacggttaaccgttaagtttaaacgtttaaacggttaacgggtcggggtacccgtttacggggttaaaccggttcccgggtaaaccgggtaaccggggtaaccggtaaggggtaaaccggtaaaagttaaacccgggtaaaaacggttcggtacggttacggccgttaaccggtaccgtaacccgttaggttcccgtttacg

SEQ ID NO: 103723 - DNA, 668 bp, Homo sapiens
  misc_feature: GYAE6OF02F3414.34.34.D01.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgagggaangcccacctctccgtgcgagggccagtcaggagtgttggcaggcctaacgttgcctggtaccagcaacgaacctggccaggcctccagcgtcctnactctagtcgacgtacacgtccgaccgacgggcctactgaccgttacttacccagtcccgtaggttccgtagtcgggactaggtcgggtacgtaggggactaggacgtttaccacttccgtaccaacgacttacgacgacaacgtcccgtgtcgaacgttctacggaacttgttaccgtgtaccgtttatttaacgtttacgtcgtactacgtacgtacgttaccgttaaagtagggttaccgtcggtacggttaccggttacggtaaccggaaccggggtaactaaacggggtacggtaaaccgtaaccggtaaaccgtaacgtttacggtagggtacctaagggtaccctaaccgagtttcccgttaccg

SEQ ID NO: 103724 - DNA, 888 bp, Homo sapiens
  misc_feature: GYAE6OF02H7SVK.34.34.D01.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
tcagtacacgtgatcacgaccggtgctcgatttagatcgtctgtgttgggtttgggggagaactgctcagttaggacccagacggaaccagtggaagccccagcgcagcttctcttcctcctgctactctggcctccagacaccactggagaaatagtgatggacgcagtctccgagccaccttgctgtgtcctacgaggggtaaancgcccaccctcttccgcgngagggccctaggtacaggtagttggttacggacacgtactaaacgtttcggccgttacggaacccgtagaccgtaacggtaaaaccgttggacccgaacgggtccttaccccgaagtacggttacccctntaactttccgtaagttccggtaacctaaccgaccgtttcccccgaaaccggaccggggtaccctaaccgtcggttaaccctaacttcccgaacggtaccgttaacggttaccgtaaaggtccgggtacggtaccgggttttaggggtcgttaacgggggtactaagggttacgtttacccgtaccgttccgtttaaccgaaccgttaacgtccggtaaccggtaccggtaaaccggtcccgttacggtaaaccgttacgggttaccgttaacggtaaaccgtttaacgttccggtttaaccgttaaccgttaacgttttttaaccgttaaccgtacggttaaccgttaccggtaaacgttccgttttaaaacgttaacgggttaacgttaccgggtccgggtagggtttaacccgtaccgggtacgtaaaccggggtaaacccggtaaggggtaacgtaaaaccgttacggaaaccgggttaaccttggggtacgtaacgtacccggtaacgtaacttaccggtactttccg

SEQ ID NO: 103725 - DNA, 806 bp, Homo sapiens
  misc_feature: GYAE6OF02JU7YZ.34.34.D01.1.454.CMB.1.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagcccacctgtctgtgtctccgagggaacgcgccaccctctcctgccgagggccagtcgaggtagtgtcgganagacctaacgttacgccgtcggtacngacgaacgaaccncggcccgacggcctacccgaggtccgtacctcactcgtacgtcgtacctacaccgtaccccgaccggacgggccctacgttccgtaccttaacgttcccgacgaccgtacggtttacgacggttcggaccggttagggttacggggttaccgttaggggaactacgggttaccgttaccgtaacccttacgtccctaacccgagtaccgacgaccgtaccggtacctcggaccttacggttactaacggtaacgtttcgttaccgttaccgttacgtttaacgtttttaaccgtacgtttacggtcgtaaccgtttacgtacgttttaacgttaaacgggttaccggttacgggttaacccgggtttaaccggttaaccggggtaaccggtaaccgggttaaacgggtaaccggtttaaaacgggggtaaaccgtaaaggttaaacccgggtaaacgttaccgggttaagggtaccggtaaccggttacccgtaacgtaacccggttacttacgggttccg

SEQ ID NO: 103726 - DNA, 715 bp, Homo sapiens
  misc_feature: GYAE6OF02GEC28.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagacgccaccctctcctgcacgggccagtcagtagtgttggcagcaacgttagcctggtaccagcaacgaaaccgtggccacggcctaccgagtacgtcctacacttctatcgacctacactacccgaccgagggccactgtaccttattcccgacgtacccgtaggtttcgaggtcggtcagggttcgggtcgtacggggacgtaaggtacgttacctaccgtaccttaccgacccgtactacctaaccgtacgaacggtacggacggtaccttaggtaaaggttcttttacggagttaagttacgttaacgttttaacgtcgtaccgtaaacgtacgggttttacggttaccgttaccctaacgtaccggttaaccgggttacgggttaccggtttacccgggaaccgtaaaccggggtaacccgtaaggggttaaacggtaacgtaaacggtaacgttaacggtaacgtaggtacggtaccgtagaaccctcgtacgttcgttcgttccg

SEQ ID NO: 103727 - DNA, 502 bp, Homo sapiens
  misc_feature: GYAE6OF02FTKE1.34.34.D01.1.454.CMB.1.raw
  modified_base (401)..(401): a, c, t, g, unknown or other
  misc_feature (401)..(401): n is a, c, g, or t
tcagtacacgtgatcacgaccggtgctcgatttagatcgtctgtgttgggtttggggggaggaactgctcagttaggacccagacggaaccatggaagccccagcgcagcttctcttcctcctgctactctggctcccagacaccactgggagaaatagtgatgacgcagtctccagccaccctgtctgtgtctccaggggaaagagccaccctctcctgcagggccagtcagagtgttggcagcaacttagcctggtaccagcagaaacctggccaggctcccagagtcctcatctatgctacatccacagggccactgctattccagccaggttcagtgcaggtggtctgggacagagttcactctcaccatcagcagcctgcagtctagaagtattcngactactttattactgtcagctagtactaatagtgccgtggacgttcggcagggaccaagggtgaaactacaaacgtacgtggtcgctgacaccgatctcg

SEQ ID NO: 103728 - DNA, 705 bp, Homo sapiens
  misc_feature: GYAE6OF02JT4V6.34.34.D01.1.454.CMB.1.raw
  modified_base (190)..(190): a, c, t, g, unknown or other
  misc_feature (190)..(190): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagtacacgtgatcacgaccggtgctcgatttagatcgtctgtgttgggtttgggggaggaactgctcagttaggacccagaccggaaccatggaagccccagcgcagcttctcttcctcctgctactctggcctcccagacaccacgtggagaatagtgatgacgcagtctccagccacctgtctgtntctccgagggaacacgccacccgtctccgtgcaggccagtcagagtgtcgnagcacttggcctcgtacngacagaacgtgccgagctccgacgtctcctctagtntacgtgtcgccagtacccgacgacgggacctcgtacgggttaccncccgacgtccggtacggtttaccgacgggttaccggcgttaacggggttcggggtttccgaaacggggtacgtaagttaacccgttaacctaacccgttcccggtaacctacccgtaacgttaccacggaccctaacgggttcctaccgtccgtacgttcggtaaacgtaagtttcgtttaccgagtttacgtttaacgtttccgtagtactccgtagttaagtaactaagtacggtcggtacccgggtttagggttcccgtaggacccgaagggtacccggttagtacggttaaccgtaacggtaacgtacggtagtaccgggcgttaccgacgtaaccgctttaggtacccgtttctaacccg

SEQ ID NO: 103729 - DNA, 701 bp, Homo sapiens
  misc_feature: GYAE6OF02GCQ2Y.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgcccaccctctcctgcgagggccagtcagagtgtcggcagcaacgttagcctaggtaccagcaagaaacctggccaggcctacccgaagacgtcctacgattcgtaatgacctaacctactacccgaccgacgggacctacgtcgtacttaacttccgaacgtcccgtaaggttccaacggtcggaccgtaaggttcggggttacgttacgggggaacctaaggtactttaccgaccttcctaacctacccgaattaccgaacgtacgaaccgtcccggttagaccgtagttaccgtaacgtaagttacgttcctacggtaccttaacgtttttaactacgttcgtaccagtactacgtttaacgttaaagttagggtaccgggtccgttacggtaaccgttccgggaaccgtaagggaacccgtaaagggtacggtaaactaccgaaaacggttatacgggtacgaccttacggacctaaccgtatccgttaacg

SEQ ID NO: 103730 - DNA, 785 bp, Homo sapiens
  misc_feature: GYAE6OF02JW209.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccacctgtctgtcgtctccgaggggaaacncgccacccgtctccgtgcacgggccaggtcaggtagtgtggacagtacaacttacgccgttaggaccaggtccaaacggaaccttcggggacccgtaacggtcccttacccgagtaccgttccctactaatccgtatcggtactaccgtaccgtacccaccggtacggcccagttacgtcttacttacccggaacgtcccgtaggttacccgaggtcgggtacgtaggggtttcggtaccggtcggggaacttaacgggtcgtttacccacttaccgttaccgaacccgtcgtaccgtacggaccgtaacggtcccgtacgacgtttacggtactaacggtaacgttcctttcgttaaccggtaccttacgttttaccgtacgttacggtacgttaaggttaccttaacgttaacgttaacggttaccgggttacgggttcggttaaccggttaccgggtaccggtaaccgggtacgggttaacgggtaacgggtaacggttaaaccggtacggtaaaaccgttccggttacgggttacggacccgtttacggaccttaaccgtcggttacctttacggg

SEQ ID NO: 103731 - DNA, 198 bp, Homo sapiens
  misc_feature: GYAE6OF02JXOXO.34.34.D01.1.454.CMB.1.raw
  modified_base (174)..(198): a, c, t, g, unknown or other
  misc_feature (174)..(198): n is a, c, g, or t
tcagtacacgtgatcacgaccggtgctcgatttagatcgtctgtgttgggtttgggggaagaggaagactgaccggtcccccaggagttcgaggtgctgggcacagcggccctgggctgcctggtcaaggctacttccatcacgtgtactgagcgggctggcaaggcgcatagnnnnnnnnnnnnnnnnnnnnnnnnn

SEQ ID NO: 103732 - DNA, 631 bp, Homo sapiens
  misc_feature: GYAE6OF02GFX10.34.34.D01.1.454.CMB.1.raw
  modified_base (151)..(151): a, c, t, g, unknown or other
  misc_feature (151)..(151): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (295)..(295): a, c, t, g, unknown or other
  misc_feature (295)..(295): n is a, c, g, or t
  modified_base (372)..(372): a, c, t, g, unknown or other
  misc_feature (372)..(372): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactgganaaatagtgatgacgcagtctccagcccacctgtctgtntctccgagggaaangccacctctccngcgagggccagtcagagtgtggcagcaacttagcctggtaccagcaagaacctggaccaggcctccgagtacgtccctanatactatcgactacactcccacgagggccatcgactactccacggcctaggttcaggtggaccgaggttcgggtacngggactaggtacgttcacgttcctaccgactactcgacgcacggtacctgacgtagtacctagaactactttcgcgtactttacttttaacgtcttagtacgtatacctacggtttaacttaagggttacggtccggggttacctacgggttaaccgttacgggacccggtaaaggggacccgtaaggggttagtaaaaccgtaccgtaaacggtacttacgggtagaccgtaccggacctacgttacgttcccgtacg

SEQ ID NO: 103733 - DNA, 578 bp, Homo sapiens
  misc_feature: GYAE6OF02F0GRL.34.34.D01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (303)..(303): a, c, t, g, unknown or other
  misc_feature (303)..(303): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagngccaccctntcctgccagggccagtcagagtgttgcagcaattgcctggtaccagcagaaacctggccaggcctccagacgtcctcatctatgctacnctccacgacgggccatgctacttccagcctaggttccagtcggcaggtgggtctggggacaggtacttcacgttctccaccacttcagccagcctagcagttcgtaggaattacgttctcgtacttaacttttatttacctggtacctaggtacctagttactaaacgttagggtcgtccggtaggttaaccgtcggaccgaagggcctaaggggtacgaacgttaccgaaaccgtacgttggtacggtacctacggactaccgtagtcttacgg

SEQ ID NO: 103734 - DNA, 669 bp, Homo sapiens
  misc_feature: GYAE6OF02GPPG5.34.34.D01.1.454.CMB.1.raw
  modified_base (123)..(123): a, c, t, g, unknown or other
  misc_feature (123)..(123): n is a, c, g, or t
  modified_base (207)..(207): a, c, t, g, unknown or other
  misc_feature (207)..(207): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
tcagtacacgtgatcacgaccggtgctcgatttagatcgtctgtgttgggtttgggggtaggaacgtgctcagttaggacccagagggaaccatggaaccccagcgcagctctcttcctcctnctactctgctcccagatgcccccgagtaattgtgttcgacgcagtcgccagtaccaccctgtcctctgtactccgaaggggaanacgccaccctctcctgcgtacgggtcagtcagccgtttacaaccgaccgtacttcttcggccctggtaccagcagagacctggtacccaggcctcccctaggcctccgtctacttcggtttcggcgtcgtacccgaccgagggaccctcgtcggactacgtcccagaccgtacggttcgacggtacggcaaggtggtcgtcgggaacagtacgtttcacgttcncacctactcganacgaccgtccgtgacctagtccgtagtacgtagttttacgacctaggttaacttacgttacttacgtcgtacgtacgaattacggtacacgtaccgacgtaacgtcggtacgggtccgttcgtaccgggaaacgtacgggaaacggtacggtaactaaccggtaaaccggtaatcgggtacgttacgcgttacccgatacccttgtacccggtttctaacctcccg

SEQ ID NO: 103735 - DNA, 703 bp, Homo sapiens
  misc_feature: GYAE6OF02GTIJP.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctggtgtctaccgaggggaaagcgcccaccctctcctgcagggccagtcagtagtgttggcagcaacttagccgtggacagcaagaaacctcggaccgaggcctcccagtacgtcctcactactatcgactaccactccaccgacgggcctacgtcgtacctacttccgacgtcctaggttcagtggcgtagggtcgggtcgtacgggacgtaagtacgttcgtactccgtacaccgtactaccgacgacgtaccgtccgttacggcgtacgtcgtaacgtaaggtactttccgtacggtacctttaacgtttaacgtttaccggtacgttcgtacgtaccgtagttaaccgttaaacgttacgggtcggtaaccgggtttacgggtaaccggtttaccgggaacccggttaacggggaaccgtaacgggggtaacggtaaaccggttaaccggtaaaacggttaaaccggtcggttacggtacgtccggaaccgtacccgtacgtttacgttacccgg

SEQ ID NO: 103736 - DNA, 852 bp, Homo sapiens
  misc_feature: GYAE6OF02J1LHD.34.34.D01.1.454.CMB.1.raw
  modified_base (234)..(234): a, c, t, g, unknown or other
  misc_feature (234)..(234): n is a, c, g, or t
  modified_base (550)..(550): a, c, t, g, unknown or other
  misc_feature (550)..(550): n is a, c, g, or t
tcagtacacgtgatcacgaccggtgctcgatttagatcgtctgtgttgggtttgggacagggtctgcgaaggcttcaccagtccctgggcccgacctcccgcagcctcccagatgggtcctgtcccaggtgcagctggcgggagtccgggcccaaggacgtggtagaagtccttcggcacgacccctgtcccctcacctgacctctcgtcctcgtcgggcccggtcctccggtnacgtctacggttgggttaggtttaactccgttggaggtccgttagggaccgttcccgacccgacggacccggcccggtaaaggggaaaccgggtccggtagggaacggtcgggtaaggttacgggttaacctacgtttactttaacgtttcgacggtcggaacctaacccgttaacccgtaacctaccccgtaaccccgtaccgtacgtaacggtaactaacgtaaacaaccgttaatacgaccgtaagtaccacgtaaccaagaaaccgtacctacgtccctactataactcgtaacttcttacgtcgtacgcgnggtaaccggaacggtacggttaacggttacgttttaacgttacggtagtacgtacggtaagtaacgttaacgtcggtttaaccgtttccgtttaaaccgtacggtacccgggtacgggtaacccgtaacccggtacccgttaccgtaaccgtcccgttaccgtcccgtaaccgtcccgtacccgtaaccgtaaccgaccggtaccgtaccggttaccccgttcccgtaccccgtccgtaaccccgtaccccttaacgtaaccggtccgtaaccgacccttacccggttcggaaccgttcccg

SEQ ID NO: 103737 - DNA, 598 bp, Homo sapiens
  misc_feature: GYAE6OF02GC1Z4.34.34.D01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (388)..(388): a, c, t, g, unknown or other
  misc_feature (388)..(388): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctntcctgcagggccagtcagagtgttggcagcaacttagcctggtaccagcagaaacctgccaggcctccagacgtcctcatctatgctacactccacagggccactgctactccagccgaggttcagtcggcaggtggtctgggacaggtagttcactcctacacctatcgagcganccgtcgcacgttctagaacgtattcgtgaccttacgtttaattactgttaccgagtacgtacgttactaaagttaacgttcgggaccgttacgggacgtttacccgggaccgtaaccggggtaaccgtaacgggtaacggtaaaacgtaaccgaaaaccggtaacgtggtacggtacgtacggtaccctaacctacgttacgtttaccgg

SEQ ID NO: 103738 - DNA, 741 bp, Homo sapiens
  misc_feature: GYAE6OF02G70HI.34.34.D01.1.454.CMB.1.raw
  modified_base (204)..(204): a, c, t, g, unknown or other
  misc_feature (204)..(204): n is a, c, g, or t
  modified_base (494)..(494): a, c, t, g, unknown or other
  misc_feature (494)..(494): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggctccagacaccactggagaaatagtgatgacgcagtctccagccacctgtctgtctcgtccgaaggggaanacgccaccctctcctgccacgggccaggtaccaggtacgttcggttcggacacggtccttaaaacgtttacggcccgttacgggtaccctaacggaccaacggtaaaacccgtcggacccgaacggtccctacccgaacggtacgtccctacacttccgttagttacggacctacgtacttacccgaccggtacgggacctacgtcggtaccttactccgacgccgtacggttcgaggtcggtacgtaggttgggtacggtggacacggtacgttcaccgttccgtaccnctactacgacgccgtacgccgtcgcgtacggtactagggtaacttacgtcgtataccttacgttttactacgttcggtactacggtacgttacgtacgttaatacggggtaggttccggttacggttaccgggtaccgggtaaccggtaacggggtaaccgttaaggggtaacgtaaaccgttaacggtaaaacggtcgtttagggtaccggtcgtaccggtaccaacggttcgtttccgttaccgg

SEQ ID NO: 103739 - DNA, 804 bp, Homo sapiens
  misc_feature: GYAE6OF02FF6GS.34.34.D01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (522)..(522): a, c, t, g, unknown or other
  misc_feature (522)..(522): n is a, c, g, or t
tcagtacacgtgatcacgaccggtgctcgatttagatcgtctgtgttgggttgggggaggaactgctcagttaggacccagacggaaccatggaagccccagcgcagcttctcttcctcctgctactctggcctcccagacaccactggagaaatagtgatgacgcagtctccagcccaccctgtctgtgtcctccgaggggaaacngcccaccctntccngccagggccagtcagngtgttggcngtccaacttgcctggtaccagcaggtaaacctggaccaggcctccccgagacgtcctctatcgtatgacctactacgtcccaccgcgggaccctatcgtaccttacttccgaacggtccctaggtttaccagggttcggactagggtcggggtactcgggggtaacctagggtactttccggaccttccgtaaccctaccgtaagttccgaaacggtccccgtaaaccggtcccgtttacgggaccttaaacgggttccgttaacggaaccggttntttacccggttcgaccttttaaaccgttttacgttttaaccgacggtttaccgaacgggtaccgttaaccggtaacgttttaaaacgggaccggttttaccggggacccgtttaggggtaccccgttttacccgggggaacccgtaacgggggtaacccctaaaggggggtttaaaccgaaaccgttaacccgggtaaaaaccggtttacccggtacggggtttaaccgtccccggttaaggaacccccttaacggttaacccgtttccggttttaacccgg

SEQ ID NO: 103740 - DNA, 756 bp, Homo sapiens
  misc_feature: GYAE6OF02HU4NE.34.34.D01.1.454.CMB.1.raw
  modified_base (203)..(203): a, c, t, g, unknown or other
  misc_feature (203)..(203): n is a, c, g, or t
  modified_base (583)..(583): a, c, t, g, unknown or other
  misc_feature (583)..(583): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagatatcaccggagaaattgtgttgacactagtctccaggcaccctgtctttgtctccaggggaanagccacctctcctgcagggccagtcagtagtagttaatagccattcctaacgttacgccgttaggtaacctagcaaacggtaaacctcgggacccaacggccccttacccaaacgtacccttacccgttacaacgttttaaagtccggggtacgtaccgtaattaccgtacggaccggggtcccccgtagggtaccacttaccccgaaggtaaccgtaggttaccgaggttcggagtaggggttcgggttcacggggaactacggtaccttcgaacctttccgtaaccgactaagtccgaagcgaacgtccgttgaccttaacgtctaagggaaacttgttaccgtacgtactttaaacgttttaacttcgtacgtttanaccggtccttaaggttacgttaaagtaacgggtcggtaccggttagggtaaacccggtttcggaacggttaacgggaaccgtaaggggttacgaaaccgtacgtaaaaccggtaacgttggtccggtaccgtcggacctaaggtaccgttattaccggttcctacgttacccg

SEQ ID NO: 103741 - DNA, 726 bp, Homo sapiens
  misc_feature: GYAE6OF02G4KZ0.34.34.D01.1.454.CMB.1.raw
  modified_base (241)..(241): a, c, t, g, unknown or other
  misc_feature (241)..(241): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgcagtctccagccacctgtctgtgtctcgaggggaagacgccaccctctcctgcgacgggcagtcagagtgttggnagacaacttcgccgttggtaccagacaacgtaaccgtcggaccacggcctaccgagacgtcctacacttctatcgtacctacgtacctaccgaccgacgggacctaacgtcgtaccttaacttcccgaacggtccctaagggtttcgacggttacggtacgtacgggtttcgggtacggtggggaacctaggttacgtttaccgacccttacgtacccaaccgtacgtaccgacgtaccgtaaccggtccttacggaaccgttcgttaccggtaaggtaacgtttactttcgtactaccgttttaacttttacgttaccgttggtactaacggtacttaacggtaacctttaaacgggttggtaccgggtaacgggtttaccggtaaccgggtttacccggaacggtacgggtaaccggtaaagggttacgaaacctacggaaacgttcgttaggctacggtacgtaccctagttaccttcgtcc

SEQ ID NO: 103742 - DNA, 715 bp, Homo sapiens
  misc_feature: GYAE6OF02JNYIO.34.34.D01.1.454.CMB.1.raw
  modified_base (496)..(496): a, c, t, g, unknown or other
  misc_feature (496)..(496): n is a, c, g, or t
tcagtacacgtgatcacgaccggtgctcgatttagatcgtctgtgttgggtttgggggaggaactgctcagttaggacccagacggaaccatggaagcccagcgcagcttctcttcctcctgctactctggcctcccagacaccacgtggagaaatagtgatcgacgcagtctaccacgccacctgtctcgtctcgtaccgaaggggaaacacgacctaccctctccgtgacgcgggacctaggtcaaggtagtggttgggacctaacgccgtaacgttaccgccgtacggtaaccacggaccgtaacgaaacccgtcggaccgacggccctcccgaagtacgtccctactgtacctattccgcctaacttaccgaccgaacccgacgggtacctacgtcgtaaccttctccgaacgcccgttaaggtccacgtggtacgtcggttacgggtcgtcgggaacgtgtacggtttaccacgtcctacgtacacgtacncggtacacgtcctagacgtacgtaccgtagtacgtactttcgtacctaacgtttacttacgttaactcgttacgcgtacgttagtaaccttaaggtacgttccggtaccgtcggtaaccgtacgggtacccgtaacggtacgtaacgggtaacgtaacgtaaccgtaaacggtcggtaagttccggtactaaccgggtaccacgttaactcgttacccg

SEQ ID NO: 103743 - DNA, 530 bp, Homo sapiens
  misc_feature: GYAE6OF02HBMPP.34.34.D01.1.454.CMB.1.raw
  modified_base (203)..(203): a, c, t, g, unknown or other
  misc_feature (203)..(203): n is a, c, g, or t
  modified_base (345)..(345): a, c, t, g, unknown or other
  misc_feature (345)..(345): n is a, c, g, or t
  modified_base (420)..(420): a, c, t, g, unknown or other
  misc_feature (420)..(420): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccctctcctgcagggtcagtcagcgttctaacaccgacttcttcgcctggtaccagcagagacctggccaggctcccaggctcctcatcttggtgcgtccaccagggccacgtggcatcccagacagttcagtggcngtgggtctggacagactcactctcaccatcagcagacttgagcctagaagtatttgctagttatattactgtcanacaatatacgagtacgcacgttgtcgggtacgttccggaccgaacgggaccgaagggtaggaaactacgaaacggtaacgtgtaggctcggaccaccgtattctgttacc

SEQ ID NO: 103744 - DNA, 598 bp, Homo sapiens
  misc_feature: GYAE6OF02GHN20.34.34.D01.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (593)..(593): a, c, t, g, unknown or other
  misc_feature (593)..(593): n is a, c, g, or t
  modified_base (595)..(597): a, c, t, g, unknown or other
  misc_feature (595)..(597): n is a, c, g, or t
tcagtacacgtgatcacgaccggtgctcgatttagatcgtctgtgttgggtttgggggaggaacgtgctcagttaggacccagacggaaccatggaagccccagccgcagcttctcttcctcctgctactctggcctccagacaccactgggacaaatgtgatgacgcagtctccagccacctgtctgtgtctccgaggggtaacncgcccaccttntcctgcacgggccagtcagtacgtgttaggcagcacttgcctggtacngtcaagtaacctgaccacggcaccgagcgactnatctatcgactacacgtccacgcggctagtcgtactacgtccacgtcgtaagttcaggtcggactaggcggttacgaggactcgattccaaccttcgacactacacacgtcacgtctcgactacgtactagacgtacgttacgtcgtacgttacgtttaacttacgtacgttacgtacgtacgtacgtacgtaacgtacgtacgtacggtacggtacgttaccgaccgtacgggtaacgtacggtaacggtaacgtaaccgtaaacgtaacgtacggtacggtacgtaccggtancnnnc

SEQ ID NO: 103745 - DNA, 966 bp, Homo sapiens
  misc_feature: GYAE6OF02HQ6N0.34.34.D01.1.454.CMB.1.raw
  modified_base (113)..(113): a, c, t, g, unknown or other
  misc_feature (113)..(113): n is a, c, g, or t
  modified_base (922)..(922): a, c, t, g, unknown or other
  misc_feature (922)..(922): n is a, c, g, or t
tcagtacacgtgatcacgaccggtgctcgatttagatcgtctgtgttgggtttgggggaggaactgctcagttaggacccagacggaaccatggaagccccagcgcagcttcncttcctctcgctactctggctcccagaccaccactggagtaaatagtgatgacgcagtctccagcccaccctgtctgtcgtcgtaccgaagggggaaacacgcccacccgttcttccgaggacgtagggcccaaggtcgaaggtacggttcggttacggactacgacctaaccggtttaggccccgttcggttaaaccacggtaaccgaaacgggtaaaccccgtcggggtaccccaacgggtaccctaaccccgggtaggtaaccggtttaccccccgtataactttacccgttaacgttaccggaacccttaacccggtacctaaacccccgtaaccggaaccggggaaccctaaccggtcgttaaccttaacgtttcccggaaaccggtacccttaaacgggttcgtaggggttacggtccgggttaacgggttacggggttaccgtaggggtaaaccgtacggtttaaccgtttccggttaaaccctttccgtaaaccccggtaacccttaacggttaccggaaacggtacccggtaacggtcccgtttacggtaaacccggttaaccggggttaacctttaaacggggtaaaccgtttacgtttacccggtttaccggtaactttttaacccggtttaacttttaccgtaccggttaaccagtaacccgttaaacggttaaccgttaaacgggttaacgggtttccgggaccgggttacgggtttaccgggttaacccggtacccggaaaccgggtaccggtaaagggttaaccggtaaaccgtaccgggtaaacgttaccggnggttaccgggtacaccggttaccgaacctttaggtccgtttacc

SEQ ID NO: 103746 - DNA, 694 bp, Homo sapiens
  misc_feature: GYAE6OF02IHJZK.34.34.D01.1.454.CMB.1.raw
  modified_base (204)..(204): a, c, t, g, unknown or other
  misc_feature (204)..(204): n is a, c, g, or t
tcagtacacgtgatcacgaccggtgctcgatttagatcgtctgtgttgggtttgggggaggaactgctcagttaggacccagacggaaccatggaagccccagcgcagcttctcttctcctgctactctggctccagacacatgagaaatgtgatgacgcagtcctccagcccacctgtccttgtgtcctacgaaggggtaaancgcccacctctctgcagggccagtcagtagtgtgcagctaacgttgcctcggacagcgaacgtaaccgtggaccaggccctccgagtacgtccctatacttctaacgtcgtacctaccgtaccgtaccgacccgtaacgggccctaacgtcgtcccgttaaccttaccgaccggtacctacgggttccgtacgggtcggcggtacggggtttcggtaccgggtacgggacctaggtaccggttacaccttactcccgtaacctacgttcgaacttccgacgtcccggtactcgaaccggtacgtacggtaaattcgttcgtaaccgttcttaacgttttactcgttaccggtactaccggtataacgttacgtaaggttcggtaccggtcgggtacgtaccggttacgacgggaacgtaaccggtaggtaacggtaacctaacgtaaacggtaccgtagggtccctagtaccgaccgacgtctacgttcg

SEQ ID NO: 103747 - DNA, 772 bp, Homo sapiens
  misc_feature: GYAE6OF02FJTXO.34.34.D01.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagtacacgtgatcacgaccggtgctcgatttagatcgtctgtgttggtttggggaggaactgctcagttaggacccagacggaaccatggaagccccagcgcagcttctcttcctcctgctactctggcctcccagactaccactggagaaataggttgattgacgctagtctccagccaccctgtctgtgtctccgaggggaaangccacccgtntcctgccagggccaggtccagagtgttggctagctaacttacgccttggtaccaggtcaacgtaaacctggcctaagggtccctcccgaaggtacggttccctacctagttcgtacgtacgacctttaacaccgttacccgaaccggtaacggggccctaacgtggtacccgttatttacccgaacggtcccgtaaggttccaaggttcggaccgtaagggtttcgggttaccgtagggacctaggtaccgttcctaccgttcgccaccgttagtaccgagtccgtaacggtcccgttaggcgttaacggttcctacgtaaaacggttactttaccggttacgttacccggttaaacctttttacgttaaccgtagttaaccgtaccgtacggtaacgtttaaccgttaaaggtacggtttaccgggccgtttaacgggtacccgggtttaccggtaacccgtaacggggtacctaaacggtttggtaccgtaaacgttaaccgaaacggttagttcggacgggttacccgttaaggcctaccgtagtttccgg

SEQ ID NO: 103748 - DNA, 828 bp, Homo sapiens
  misc_feature: GYAE6OF02H29PV.34.34.D01.1.454.CMB.1.raw
  modified_base (214)..(214): a, c, t, g, unknown or other
  misc_feature (214)..(214): n is a, c, g, or t
tcagtacacgtgatcacgaccggtgctcgatttagatcgtctgtgttggggtttgggggaggaactgctcagttaggacccagacggaaccatggaagccccagcgcagcttctcttcctcctgctactctggcctccagacaccacgtggagaaatagtgatgacgctagtcctccacgcccaccctgtctgtgtccgtacgaaggggaaacncgcccaccctcctcgtgcgacggccagtcaggtgttggtggcagactaactcgcgtaggaccagaccaacgaaccgtcggaccgacggtaccctacccgtaggtacgttccctataagtttacggtggtactactaacgtaaccgtaccggacccgggtccccgtaggtacccaccgttacccggaagtaccggttaacggttacggtaacggttcggacgggttagggttacggggtccggtaacggggaacctaacggttacctttaccgaacccttccgtaacccgaaccctacgtacccaaaccggtaggtaccggtaccggggtaacctccggttaaaggttacgtttacgttacggacgtttaaggtttacgtttaaacgtttacgtcgtaaacgttaacggtttacggttccggttaacaccgtaacgggtaccggttacgggttaaccggtacgggttacccgggaaacgggtaacgggtaaaccggtaagggtaaccggttaaaccgtaaccggaacggttaacggttcgggtcgtaacccggtacgtacccgttaacgtttccgttccgtttaccgtttaaccgtccgttacccgttaccccgg

SEQ ID NO: 103749 - DNA, 787 bp, Homo sapiens
  misc_feature: GYAE6OF02JDIEI.34.34.D01.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagacaccagtggagaaatgtgatgacgcagtctccagcccaccctgtctgtcgtctccgaggggaaancgcccaccctcttccgngcgacgggccagtcagagtgttggcagctaacttcgccgtaggtaccagactaacgaaccgtcggaccgaggacccttacccgaagtacgttccccgttacactacgttagtcgtacccttaacgacccgtacccgaaccgtacggggtacccctaacttacggtactttaacccgttccgaaccggtacccgttaacgggtttacgaacggtcgggtaccgtaaggggtttccgggtacggtacggggaaaccgtagggttaccgttacccgtaccgttacccgtacctaacccgtaaccgtacgtaaccggtaccgaacccggtccgtaaccgtcgtaaccggttacgtacgtaaacgtacgtttacgtacggttaccttaacgttttactttacgcgttactacgtactacgttaaacgtttaacgtaaggtccgttacggtacggttcgtaaccggtaccggtaccggtaacggtaacggtaacgggttaaaccgacgttaaaccggtacggtcggttaacgtccgttaacgtccgtaacggttcccgttaggttaccg

SEQ ID NO: 103750 - DNA, 792 bp, Homo sapiens
  misc_feature: GYAE6OF02JM7HC.34.34.D01.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (370)..(370): a, c, t, g, unknown or other
  misc_feature (370)..(370): n is a, c, g, or t
  modified_base (496)..(496): a, c, t, g, unknown or other
  misc_feature (496)..(496): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatgacgctacgtctccagcccaccctggtcctgtcgtcctaccgaaggggaaacgcnccctacccctnttccngcgacggcagtcagtagtgttcggnacgtaccgtaattacgccgttacggaactacggacgtaaccgaaccgttccgggacgacgtccccgttacccgagtaccgttcctaacagtttccgacgttcgaccttaacnccgtacccccgacggtacggtaacccctccgttactaccggtttacacccgggtaccggtaccgtttaacgggtactacggggtttaccggtaacgggttccggggttacgttttaacccgggggnggaaaccgtttaaccgggtcgttttaaccgaacccggttccgtaaacccgtacgtaccgtacgtccggtaaccgccgttccgtacggtcacggtttacgaacgtacgttacttacggtactacctttagttacctcgtacacgtacgtacctacgttactaacgggtacgtccggtacgttacgggttccgtacggtaaccggacgttaacggtaacggttaaaccggtaaaccttaacggtaaacggtaccgttaggtaccgggtacttacgaacctaccgtacttcgttacccg

SEQ ID NO: 103751 - DNA, 586 bp, Homo sapiens
  misc_feature: GYAE6OF02FTYFW.34.34.D01.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctccagacaccactggagaaatagtgatgacgcagtctccagccaccctgtctgtgtctccgagggaaagngccaccctctcctgcagggccagtcagagtgtggcagcaattagcctggaccagcaagaaccgnggccaggcctacccgagacgtccctcatctaatcgctacactaccaccgagggccactcgacttacttccaagtcccgtaggttccaggtgacgtaggtcggggtctagggacaggaacgtttccgacttcctaccgacctagtccagcaacgcctgaccgagttcgtagaacgtagttctacggtcttaaccgttttattaactgttacagactacgtactaagtacggtcgcggtaggtccgttcgaccgaggtaaccggaaggtaacaagtaccgaaacgtagtcggttacggcctaggaccaccgtatcgttccg

SEQ ID NO: 103752 - DNA, 896 bp, Homo sapiens
  misc_feature: GYAE6OF02JW216.34.34.D01.1.454.CMB.1.raw
  modified_base (205)..(205): a, c, t, g, unknown or other
  misc_feature (205)..(205): n is a, c, g, or t
tcagtacacgtgatcacgaccggtgctcgatttagatcgtctgtgttgggtttgggggaggaactgctcagttaggacccagacggaaccatggaacgccccagcgcagcttctcttcctcctgctactctggcctcccagaccaccacgtggagaaatagtgactgacgactagtcctccagcccgtaccctgttctgtcgtcnccggaagggaaagccgacccacccttccgtacctcggcgacggggtcctaggtactacggtagttcggttccggaactcggttaactaaaccgttacggtacccgttacggggttaacccaacggaccggtaaaccggaaaacccggttccggacccgtaccgggtacccctacccggtaacgtaccgttaacccctctaaccgtttcgtacgtacgtaccctactaacccgtacccgaaccggtaccgggaccctacgtcgaaccttaaccgtccgtaccgcgtacggtacgtacggggtatacggttaaggtccgggtaggtccgggaaactaggttaccgttacccgaccgtttaccacgtaaccgtaaccgtaccgtacgtaccgccggtaccgtcgtaccgtaccggttaacttaacggtaacgttacgtttaccgttaccgttttacctttaacgttttaaacgtttccgttaccggttaccgtaacggtttacccgttacggttaaaccgttaacggttaccgggtttaccgggttacccgggtttaaacggttaacccgggttacccgggtaacgggttaccgggtaacgggtaacgggtaaccgggtaaaccgttaaaccgtaacggtaccggtacggtacgttaccgggtacgtaccgtacgttaccggtacccgtttcgg

SEQ ID NO: 103753 - DNA, 657 bp, Homo sapiens
  misc_feature: GYAE6OF02HTV2Y.34.34.D01.1.454.CMB.1.raw
  modified_base (139)..(139): a, c, t, g, unknown or other
  misc_feature (139)..(139): n is a, c, g, or t
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (441)..(441): a, c, t, g, unknown or other
  misc_feature (441)..(441): n is a, c, g, or t
tcagtacacgtgatcacgaccggtgctcgatttagatcgtctgtgttgggtttgggggaggaactgctcagttaggacccagagggaaccatggaaaccccagcgcagcttctcttcctcctgctactctggctcccanatcgcccccggagaaattgtgttgacgcagtcgccagacaccctgtctctgtctccgagggaaancgcccacctctcctgcagggtcagtcagtcgttctaacnccgacttcttcncctggtaccagcagagacctggcccaggcctccgaggcctcccgtctattcgtttggtcgccgttcccaacgacgggccctaatcgggtcacgtccccaggaaccgtggttccgaggtggactaggtcggggtctagggacaggttaccttcaccgttctacgaaccattacgagtccagtcccgngtctaagtctaggtaacttagttttagactaagttatacttacgttcgttcgacgtaactaactaacgtacgaacgtacgtaccgtacgttggtcggggtccgtttacgggaaccgaaacggggtacgaacggttaacgggaaactaccggtaaacgtaacggtcggtaccggtaactccggaactaccgtaacctaccgtcgttacttactaccg

SEQ ID NO: 103754 - DNA, 769 bp, Homo sapiens
  misc_feature: GYAE6OF02HR4PX.34.34.D01.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (313)..(313): a, c, t, g, unknown or other
  misc_feature (313)..(313): n is a, c, g, or t
tcagtacacgtgatcacgaccggtgctcgatttagatcgtctgtgttgggtttgggggaggactgctcagttaggacccagacggaaccatggaagcccccagcgcagcttctcttcctcctgctactctggctcccagacaccactggagaaatgtgatgacgcagtctccagcccaccctgtctgtgtctccgaaggggaanacgccaccctctcctgcgacgggccagtcagagttggtggacngctaacttgcctaggtaaccaggacaacgaacctggaccgtaggcctacccgagtacgtcccctanacgtacctacgtccgcttaaccgactccccgaaccggacggggtccctaacgtgtaccttaacgttcccgacggtccttaacggttcgaagggttcggtaccggttaaggttccggggttacggtacggggtaaacctaaggtttccggttacctaccgtttcctaaccacctagtaccccgaggttaccgaaccggtcccgttacgggaaccttacgggttaccgtaaggtaaacgtttaccgtttacgtttaccgtaaaccgttttaccgttttaacgttaaccgttacgtaccggtacgtaccgttaagttacgttaaacgttacgggtccggttaaccgggttcggtaacgggttccggtaaccgggttaacgggaaccggttaaggtaaccggtaagtaaccgtaacggttacgtggtacgggtcgtaccgtaccgacgttcgtcgttacg

SEQ ID NO: 103755 - DNA, 749 bp, Homo sapiens
  misc_feature: GYAE6OF02JMOA5.34.34.D01.1.454.CMB.1.raw
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatgtgatgacgcagtctccagccacctgtctgtcgtctaccgaggggaaacgcgcccaccctcgtccgtgccgacgggtccaggcaggtacggttgttcggcagacaacttcgcctggtaccngacaacgaaccgtcgccgngacctccgacgcgtccctcgtactctagtacggctacctacgtacccgacgaccgggtaccacgttcgtaccttaacgtaccgacgtccggttaaccggttctaacgggtcggaccgtgggtttacgggtcgtacgggtaacgtaacggttcgttacccgaccttaccgtcgtaacccgtacgtacccgaacggtaccgtaccggtcccttaacggtacgtacggttaacctcggttaaacggttcttccgtacgttaccttaacgttttacgttacgtacgttaccgtagtaccgtacgttaaccttaaagggttacgtccgggttaccgtaacggggttccgttacgggaaccgtaacgggtaacggtaacggtaacggttaaacgtaaccggtaacgttaccggtaggtaccggtactaaccggtaccgtacgttacgtacgtttaaccg

SEQ ID NO: 103756 - DNA, 822 bp, Homo sapiens
  misc_feature: GYAE6OF02HHXAA.34.34.D01.1.454.CMB.1.raw
  modified_base (528)..(528): a, c, t, g, unknown or other
  misc_feature (528)..(528): n is a, c, g, or t
tcagtacacgtgatcacgaccggtgctcgatttagatcgtctgtgttgggtttgggggaggaactgctcagttaggacccagacggaaccatggaagcccagcgcagcttctcttcctcctgctactctgctccagacaccactggagaaactagtgatgaacgcagtctccacgccaccctgttccgtgtcgtcctccggaagggggaaacgacgcccaaccctcctccgtgccgacgggcccaggtccaggagttggttacgcagctaaccttagccgtggtaccagactacgaaaccctggaccgacggccctacccgacggtacttcccgtactactacttacgtcgtactaaccgtactaaccccgaccgtaccgggtaccctacgtaccggtacttaaccgttccgtaacggtacccgttaagggtttcccgaagggttccgggtacggtacgggtttcggggtcgtaaggggtaacccgaaggggtaaccgtttcgtaccgttaccctaccgttaaaccgngtaacccgtacggtacctaaccgggtacccgtaaggtaaaccgtaaccctttaaaggtttacggttttacgaaaccgtttttaattttaacgtttaaccgtacgttacctaacgggttctacggttcgttaaccggccgttaacgtaccgtaccctttaccgtcgggtaccttccggttaccggttacccggggacccgttgggaacccggttccggaaccgggttgggtaaccggtttaaacgtaaccgggtaacgttcgggtaacggttccacgggtaccctacgttcccgg

SEQ ID NO: 103757 - DNA, 856 bp, Homo sapiens
  misc_feature: GYAE6OF02JDMAR.34.34.D01.1.454.CMB.1.raw
  modified_base (149)..(149): a, c, t, g, unknown or other
  misc_feature (149)..(149): n is a, c, g, or t
tcagtacacgtgatcacgaccggtgctcgatttagatcgtctgtgttgggtttgggggaggaactgctcagttaggacccagacggaaccatggaagcccagcgcagcttctcttctcctgctactctggctccagacaccacgtgganaaatagtgatcgacgcagtcctccagcccaccgtgtctgtcgtcctaccgaggggaaacgcgcccaccctctaccgtgacgtagggtcagtcacgtcgttactaacaccgtactttccgtcgccgttaggtaccagcctaacggagtaccgtcggacacgggtccctaccgaggccttcctacgtagtttcgtttgggtaccgaccgtacccgaccggcggggacccctagtccggacctaaccgttcccgaaaggtccgttacggtttccaacgggttgggaccccgttaaggggttccggggtttccggagggtaaacccgaacgttcccgttacgtacccgttaaccggtccaaacccggtttaaccgtacgtacgtaccgggtaacgtttacggaccggttaccttaagttaaaccgggtttacgtttacgtaacccggttaattaaacggttttccgtttaaccggtttccgtaaccgtaaccggttacgttaaacggttaaccttaccggggtaaccgtaccgtacccggttacgggtttaacggggtcccggggttaccccggttaaccggggaaccgggtaaccgggtaaccgggttaaggttaaaccgggtaactaaacccggtaaacgggtccggttaaagggtccgtaccgttaccggaacgttaacccttaggtttacccggtaaccgtttaccg

SEQ ID NO: 103758 - DNA, 776 bp, Homo sapiens
  misc_feature: GYAE6OF02JO1O3.34.34.D01.1.454.CMB.1.raw
  modified_base (185)..(185): a, c, t, g, unknown or other
  misc_feature (185)..(185): n is a, c, g, or t
tcagtacacgtgatcacgaccggtgctcgatttagatcgtctgtgttgggtttgggggaggaactgctcagttaggaccagacggaaccatggaacgccccagcgcagcttctcttcctcctgctactctggcctcccagacaccacgtggaagaaatgtgatgacgcagtctccagccaccgtntctgtctctaccgaaggggaacacgccacctcgtcctgcgacgggccagtcacgtaggttgtcggaccaggacctaacttacggtccttacgggtaaccagtaccgtaaacggtaaaccgttcggaccgtacggccctaacccgacgtacgtccctacgtaactcctagtcgacctaactacgtacccgaccggaccgggtaccacgtaccggtaccttacgttacccgaacggtacccgttaacggttcggaacggttcgggacgttcggtttccggggtacgttacgggggaaccttaggtaccggttaccgtaccgtttaccgaccgttaaccgacgttaccgacggtaccgtacgtaccgttacggtacgtaacgttcccgaaggttaacgtaggttccggtaggtttaacttcgttttaaagttccgtacgtacgtaacgtaacttaagtttaccgttaacgtccttacccgtccttacgttccgttaccggttcggaccgggttaacgggtacggtaggtaacggtacggtaaccgtacgtaaacggttccgtacggtacggttaccgtacgtaccgtacgtcgg

SEQ ID NO: 103759 - DNA, 706 bp, Homo sapiens
  misc_feature: GYAE6OF02I301J.34.34.D01.1.454.CMB.1.raw
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
tcagtacacgtgatcacgaccggtgctcgatttagatcgtctgtgttgggtttggggctgggagaggagcccagcactagagtcggcggtgtttccattcggtgatcagcactgaacacagaggactcaccatggacgtttgggactgagtcttgggttttccncgttgcttcgttttaagaggttgtccagttgtcaggtncaagctggtggtaggtcggtgggggacgcgtgggcccctaaggccgttggggaacccgttccgtggaacgtaccttctcccgtggtaccgtcgacgggtcgtttccggaaggtaactttccaaccccgttgagtttacgtcaaggttcgaccgtaatcggaccctacggtcgggtccccgcgaaggtccgtaacacgggtacggaggggtcgtgggtaacggtggggtcgtaacgttaagtttacgaagttggtagtaggacggtaaggttaaaggctaaccggtaataccgtagtaccggaactagtaccgtcggttaacggaacggtcgtaacttccggtaaccgtcgtacaacggacgtaaccaacgtaaccgtaacggaactaccggactagttactccgtaactacgaataccgtacgcgttacaggtaacgacggtccggacacggcgtaactacgttacgttaacgtcgtgaggtccgagagacggtacacgtaccg

SEQ ID NO: 103760 - DNA, 724 bp, Homo sapiens
  misc_feature: GYAE6OF02HQYR1.34.34.D01.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
tcagtacacgtgatcacgaccggtgctcgatttagatcgtctgtgttgggtttgggggaggaactgctcagttaggacccagagggaaccatggaaaccccagcgcagcttctcttcctcctgctactctggctcccagatcgcccccggagaaattgtgttgacgcagtccgccagaccaccctgtctctgtctccgaaggggaaancgcccaccctctcctgcgagggtcagtcacgtcgttactaacaccgtacttctcgcctcgtaccngcagacgaccgtggccacggcctcccgaggtcctccctctacttcggttttcggtcggtcccgtacccgacccgacggggccctaacggtccggacctaccgtacccccgaagtaaccgtacgggttaccaggtcggacgtaggtcggggtacgtacgggacctaaccggtactttccgacttcctacctaacctaagtccgaagacgtaacgtacgttacgtacgacggttacgtaacggttacgttttagactacgttattaacgttaccgttacgtcgtaagaacttaacgtactacgtaacgaacgtaccgtagttcggtcgggtaccgttaccggaaccggtaacggaaaccgtaagggtaaggaaccttaacggaaaacgtcggttacgtacggtacctacgacctacgtacgttaccgttcggttaccttacgtaccttacccg

SEQ ID NO: 103761 - DNA, 676 bp, Homo sapiens
  misc_feature: GYAE6OF02HO5NS.34.34.D01.1.454.CMB.1.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagacaccactggagaaatagtgatcgacgtcacggtctccacgccctaccctggttcctgtcgtccgtccgaaggggaaancgccaccctctcctgcgaggccagtcnggacgtggtcgnancacttgcctgaccngacaacgaacctggacncggactccagactccnctactctactgactacactacccacgacggccacgttcgcctactccactccggacggttcgagggtacgtcagggttcggggtactgggaactgtaaccgtctaccgttctaccgacctactacgtacgacgtccgtccgtacgtactaaccggttcgtaaacggtacgttaaccgttcgtttacccgacttttaaccttttacgttccgtacgtactacgtacgttacgttaacgtaaggtaacggttccggtacgggttcggtaccggttacggaccgggtaacggtaacgtaacggaacgttaacggaacgttaaaccgtccggttaagtcggtacgtaccgtaaccgtacgtaccttgttaccg

SEQ ID NO: 103762 - DNA, 741 bp, Homo sapiens
  misc_feature: GYAE6OF02FIYCO.34.34.D01.1.454.CMB.1.raw
  modified_base (126)..(126): a, c, t, g, unknown or other
  misc_feature (126)..(126): n is a, c, g, or t
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
tcagtacacgtgatcacgaccggtgctcgatttagatcgtctgtgttgggtttgggggagaactgctcagttaggacccagacggaaccatggaagccccagcgcagcttctcttctcctgctacnctggctcccagacacctatggagaaatagnactgacgcagtctcagccacctgtcgtntctacaggggaangccgacctctacctgccgagggccaggtcagtatgttcggacaggtcaacttagccttgggaccagcaagtaaaccgtggaccgaggcttaccgaggtacttaccgacatctagtcgtctaacataccacgtaaccggcgtaactcgtaccttacgttccgaagttacccgtagttaaccgacgttacggacgttaacggttagggttccggtaaacgggtacgaacgggttcgtttaaccaccgttaacgtccaaccgtacgttaacacgtacgtacggtacccgtagtccgtaacggttactaacggaaacgtacgttcgtaacgtaccgttaaactttacgttacgttacgtaccgttacgtaacggttaacgtaccggttaaacgtaacgggttaccggtcccggttaaaggtcccggtttaaccgggttaaccggaaaccgggtaaccgtaaacgggtaaacgggtaaaccttacgggaaaaaccctttaacggtacggtaacggtctaaaccgggtacctacgtacgttcttaaccgg

SEQ ID NO: 103763 - DNA, 912 bp, Homo sapiens
  misc_feature: GYAE6OF02HDF8C.34.34.D01.1.454.CMB.1.raw
tcagtacacgtgatcacgaccggtgctcgatttagatcgtctgtgttggggtttgggggaggaactgctcagttaggaccagacggaaccatggaagccccagcgcagcttctcttcctcctgctactcgtcggcctcccacgacaccacgtggaacgaaattgtagactggacgcagtcctcgagccctacctgtcttgtcgtacgtccggaaggggtaaacgtacggccctaacccgttcctaccgtaggtaccggaaccgggtcccgtaacgttacgtaacggtacggtttcgggtttacggacgacgttaaccgtaacggtttaacggacccgttaggtaacccgaggaacccgaaaacgggtaaaaccccgttgggacccggtaccggtacccgtaccgtaacggtacgttccccttaccaacgttacctaacgtacggtaaccttaaccgtaccgtaccccaacccgggtaccgggttaacctacgttaccggtaccgttaaccgttaccgaccggttaccgtcggttaacgacgttaccgggtaacggtcgggttacggtacggtagggaacgtaggtcttacctaacggtacctacgaaccggtataccgtaacgcgttaaccgacggtcgtaaccgacgttcgtaagtacgttacgttaactcggttaacttacgtttacgtacggttacctacgaggttaactaggtttaaacgttaagttaaccggggttccgacgggggttaacgttaaccccgggttaacggaacccggttaaaaccgggtaacggggtaaaacggttaccgggtaaaacctaaaccgggttaaaacgaacccgggtttagtacggggttaaccctaaccggtaaaccccggtttctaaccggtttccggtttaacccg

SEQ ID NO: 103764 - DNA, 786 bp, Homo sapiens
  misc_feature: GYAE6OF02GUHNX.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggctcccagataccaccggagaattgtgttgacgcagtctccagccaccctgtctttgtctccgaggggacagacgcccaccctctccgtggcggggccagtcagagttattagtacgcttacttcttacgccgttggtactcagcaacggaaacctgggaccctgggccgccccgacgggtccttcccctcaacttaccttaagtttaagtaccgtcccttaagtacggaccggacggggaccctacgttcgggtcccggtacccgaacggtaccgacgggttttcgacgggttggacgtaagggttggggtccggttgggggtacctaggtaccgtttccaacgttcctacccgaacctacgtacgtaacgacgaacggtaccgtgggtaaccgaccgttagttaaaggtttacgttttggaaccgttaggtttaagttaaccgttttacgttacggtcgaacgtaccgtaaattacgtacggaaccggtacgtaccgtaaggtttcgggttacggggttccggttaacccggtaaccgggaaccggggtaaccggtaaggggttaacggtaaacgtaccggaaaaccggtcgggtaaggtccgggtacgttacggaacctaccggttactttccgttagttcccgttaacccg

SEQ ID NO: 103765 - DNA, 757 bp, Homo sapiens
  misc_feature: GYAE6OF02FUECK.34.34.D01.1.454.CMB.1.raw
  modified_base (151)..(151): a, c, t, g, unknown or other
  misc_feature (151)..(151): n is a, c, g, or t
  modified_base (208)..(208): a, c, t, g, unknown or other
  misc_feature (208)..(208): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactgganaaattgtgttgacgcagtccgccagaccaccctgtcctctgtcctcgaaggggaaanacgcccacccttctcctgcagggtcagtcagtcgttacaacaccgtacctttctccgcctcggtaccagctagacaccgtggaccaggcctcccgaggtcctcccgtctagtttccgtttcggggtcgaccgtaccccaccggtacgggcccctaggtccgggacctactccccgaggacctagggtttcacggttcgggactaggggttgggtaccgtaggggaactacggtaccttccaacgtttccacccgaacctacgttcaacgtacgtaacgtaccgttcgaacgttcccggttaaggtaaacgtttacgtttcgacggttagtttaacgtttaacgtttaacgttcggtacgtaacgtacctaaacgttacggtaccgtaacggtaccgtaccgttaggttcggggttaaccgggtcccggtttaacgggaaacccggtaacggggttaacccggaagggtttaacgaaacggtttaaaccgaaacggttaacgttcggtacgtaccgtcgtaccgacttacgtcgttaccgtcttacccgg

SEQ ID NO: 103766 - DNA, 685 bp, Homo sapiens
  misc_feature: GYAE6OF02HNGPO.34.34.D01.1.454.CMB.1.raw
  modified_base (187)..(187): a, c, t, g, unknown or other
  misc_feature (187)..(187): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaattgtgttgacgcagtctcagccacctgtctttntctccgaggggacagacgccacccttctcctggccgggtccagtcgagtagttacttagtacgtacttacttcttacgccttggtactcgagcaacgaaaccgtggccgtggccgacccgaggccttccctacacttctaataactcgtaccttagtacgcgacgggaccacggtcggccgtacccgaggtaacgtacgggttcgaacggtcgggacgtagggttcgggtacgtcggggacgaacgttaccgtttacgccttacctacctactactacgacgaccgtaagaaccgttgggacgttaccgtagtaaacgtttgttacggagttagttagtttacgttacgttgtacacggacgtacgacttactacgtacgttccggtactacgttaccgttacgttacgggaccgtacgggtaacaggtaccggtaggacgttaacgaaccgtaaagtccgttaggtccggtacgacgtacccgtacgttattccggg

SEQ ID NO: 103767 - DNA, 858 bp, Homo sapiens
  misc_feature: GYAE6OF02JXVLN.34.34.D01.1.454.CMB.1.raw
tcagtacacgtgatcacgaccggtgctcgatttagatcgtctgtgttgggtttgggggaggaactgctcagttaggacccagacggaaccatggaagccccagcgcagcttctcttcctcctgctactctggcctcccagaccaccacgtagggacgaaataggtagactcggacgcagtctaccacgtcccacctgtctgttcgtactccggaagggggaaacgtaccgaccccgtaccccttcgttacccgtacggaccggaccgggacctacggtacgtaggtacggttcggttacgggcctaacggacctaaacgtttccggtaccgtacggttaaccaacggacgtaaaccgaaccggtcggaaccgtaaccggtcccgtacccgacggtacgttcccgttacaccgttcgtacgtacggtacctaaccacctacccgaaccggtaccggacctaccggtcgtaaccttaccgtaccgtacgtaccggttacggttccggtaacggttcgggacgttacggggtcgggtacggttacggacgtaacggtcgtaccgtctacccgtataccgactacggtacgccgtacgacctacggacgttaacgttacgaacgttaacgttcgttccttccgtaacttttacctttaaggttaccttacgtacgttacgtacgttaacgtttaaccgtacggttaaccgggtcgtttaaccgggtcggttaaacccggttcggggaaacgtaaccggggacgttaaaccgggtaacgggtaactaaaccgggtaaacggttacggtttaccggacggttaccggtaccgtaccggtaaccgttaccggtaacgtttaccgg

SEQ ID NO: 103768 - DNA, 730 bp, Homo sapiens
  misc_feature: GYAE6OF02H4K4A.34.34.D01.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (308)..(308): a, c, t, g, unknown or other
  misc_feature (308)..(308): n is a, c, g, or t
tcagtacacgtgatcacgaccggtgctcgatttagatcgtctgtgttgggttggggagaactgctcagttaggacccagacggaaccatggaacgccccagcgcagcttactcttcctcctgctactctggcctccagacaccactggagaaatgtgatcgacgcagtctccagtcccaccttgtctgtcgtcctacggagggaanacgcccacctctctgacgaggcctagtcagtgtgtgacngactaacgttgcctgtaccagactaacgaccgtgaccgtcgacctaccgagtaccttacctanaactttccgtaatcgtacctaccgtactaccccgacaccgggtctaacggtctacctcttacccgagtaccgttaggtcaggtcgtacgtggggttcggtacggtcggaacgtagttacgttccacgtacctacctacgtacacggtacgaccgttaacgccgtagtacgttacgtacggttaagaactttagttacgttccgttaaactttacgttttaagtaccttaacggttacgaccgttaacttaacggttacgttaaaacgggttcgttacgggtaccggttaaccggttacccgtaccgggaaccgtttaaacgggggacccgtaaggttaaacgtaaaccggtaacttaaaccggtacgtcgggttaaaccgttccgaaccggtaacccttacggtacttacccggtttaaccg

SEQ ID NO: 103769 - DNA, 747 bp, Homo sapiens
  misc_feature: GYAE6OF02IKS81.34.34.D01.1.454.CMB.1.raw
  modified_base (140)..(140): a, c, t, g, unknown or other
  misc_feature (140)..(140): n is a, c, g, or t
  modified_base (209)..(209): a, c, t, g, unknown or other
  misc_feature (209)..(209): n is a, c, g, or t
tcagtacacgtgatcacgaccggtgctcgatttagatcgtctgtgttgggttggggagaactgctcagttaggaccagacgaccatggagcccagcgcagcttctcttctcctgctactcgtgctccagacaccatgganaaatgtgatcgacgctagtctccgagcccaccttgtctgtacgtctacggagggaaagtcgcccacctntccgtgactaggcctagcagacgtgttcggctagctaacttacgcgttacggaccagaccgaacgtaaaccgtcggaccacggactccgagtactcctacgattaccgtagacgttacgtaacacgttaccccaggtaaccggtacccaacgttccgttaacgttacctaccgaacgttccggtaacggtttcgaacggttcgggtacgtacgggtttagggtcgtaacgggataacggtaccgttttcgacgttcgtttaccgaactacggaccgtaagtaccgtcgtaaaacccgtcgtaccgtaaaggttacctaagggtactaaccggtttactcggtaacctttttaacgtttaccgttagtaccgtttacgaacggtaccttaaggttaccgttaaaacggtggttaaaccgggttccggtacggttaacccggttaccggaaaccggtaccggggtaaactaacggggtaaagtaaccgtaacggtaaagtaccgaggttgaacggttacacggtactcgtacgttacccg

SEQ ID NO: 103770 - DNA, 782 bp, Homo sapiens
  misc_feature: GYAE6OF02IBSIY.34.34.D01.1.454.CMB.1.raw
  modified_base (127)..(127): a, c, t, g, unknown or other
  misc_feature (127)..(127): n is a, c, g, or t
  modified_base (152)..(152): a, c, t, g, unknown or other
  misc_feature (152)..(152): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagtacacgtgatcacgaccggtgctcgatttagatcgtctgtgttgggtttgggggagaactgctcagttaggacccagacggaaccatggaagccccagcgcagcttctcttcctcctgctacnctggctcccagacaccacgtggaanaatagtgatgacgcagtctacacgccaccctgtctgtagtcctccgaggggaaacncgaccctacccctntccgtcgccgacgggacccaggtcctaaggagtttcgttcggacaggacctaacgttacgccgttacggtaccaggtaccaacggaaccgtacgggtaccggacggtacccgtacccgagtaccgtcccgtactaacttaccgttacgttcgtacttacccgaccgttacctacccggaaccgggtacctacggtcgttaccttccgtaccgtaccggtacccgttaaaggttcggtacgggtacgtacgggtacgggttcgggttaccggtagggaccgtaggttaccgttccgtaccgttccgtaccgtacctacggttaccacgttccgaacccgtctaccgtcgttagttacgtaaggttatttacgttgttaccggtttaaagtttcgttacgtcgtacgtacgtactaacggtttaactaaggttacggtaccgtaccgttaccggtactacccggtaccgttacggaccggtaaccgaccgttaaggtaccggtaagtaaccgtaacggtaacgtacgttacgggtacgtaccgtccgtacgtaccgttaccg

SEQ ID NO: 103771 - DNA, 717 bp, Homo sapiens
  misc_feature: GYAE6OF02GQB74.34.34.D01.1.454.CMB.1.raw
  modified_base (203)..(203): a, c, t, g, unknown or other
  misc_feature (203)..(203): n is a, c, g, or t
tcagtacacgtgatcacgaccggtgctcgatttagatcgtctgtgttgggtttgggggaggaactgctcagttaggacccagacggaaccatggaagccccagcgcagcttctcttcctcctgctactctggctcccagacaccactggagaaatagtgatgacgcagtctccagccaccctgtctgtgtctaccgagggaanacgcccacctctcctgcgacggcagtcagagtgtggcagactaacttacgccgtggtaccagacgaacgaaccgtcggaccgacggcctaccgagtaccgtcctcatctactgacctacacctaccaccgacggcccacgtcgtacctacgttccgacgtcccgtaggttcgacggtcggacgtacggttcggggttacgagggtaactaggtacgttaccgaccttcccgtaccaccgactaccgaacgccgaacgtcctacgtacgtacgtacgtagtaacgttcttcgtacttaccgttactttaacgttacgttcgtacgtacgttaccgtaagttttaaccgttaaggtttaaccgggtcgggttaaccgggttccgggttaacggttaacccgggtaccgggtaaccgggtaacggtaaacgggtaacggtaaaccgttaaaccgaaaccggtttaacggtaccggttacggaccgttaccgtaccgtaacgttacgttcgttaccgg

SEQ ID NO: 103772 - DNA, 745 bp, Homo sapiens
  misc_feature: GYAE6OF02GZ304.34.34.D01.1.454.CMB.1.raw
tcagtacacgtgatcacgaccggtgctcgatttagatcgtctgtgttgggtttgggggaggaactgctcagttaggacccagacggaaccatggaagccccagccgcagcttctcttcctcctgctactctggctcccagatatcaaccggagtaaattgtgttcgacacagtcctaccgaggccacccttgttctttcgtctccgaaggggaaacgtcgcccaccctctccgtgaccgacggggtccagtacgaggtaggttagttaaacgagcgtaattacctaaccgttagtaccctacggtaacccagactaacggaaacctcgggacccaacgcccctacccgaagtaccctcccgtaataacgtttaggtaggcgtactacttaaccgtaccggtaccggggtacccctggaccttaaccgaccccgtagtaacggtacggttacaccgggtaggtacgtacggtttggggtaccgtaacgggacgtacgtcgtttaccaccgtttacacctaaaccctcgtacccgacctaacgtaccgtacggtacgtacgtaagttacgttacgttcgtacgttacgttgtaacgtttacgacgttactaacgtagttacgtctacacgtacgcgttaggtaccgtacgaaccggaagggtacaaggtaccgtaagtacgtaaccgtagtacggtagtacgacgtaccgtactaacgttcttaacgtcttactacgtcccttaccg

SEQ ID NO: 103773 - DNA, 588 bp, Homo sapiens
  misc_feature: GYAE6OF01BMZNO.17.34.D01.1.454.CMB.1.raw
  modified_base (515)..(515): a, c, t, g, unknown or other
  misc_feature (515)..(515): n is a, c, g, or t
  modified_base (571)..(571): a, c, t, g, unknown or other
  misc_feature (571)..(571): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgtggacaggaacccttggtcttccggcgagcgggctttcggacccgacgttctcgtacttagtgtcagcattcgcacttctgatacctccagcatcgcctcacagcacaccttcacagcttacagaaccgcctccctaacccaacaacgcataacgcgtcgctgccgcagtcttccggngccagttcggtttactcccccggtttcacttccctttaccccgcctacttccgtanacgttagtcctaaccgg

SEQ ID NO: 103774 - DNA, 551 bp, Homo sapiens
  misc_feature: GYAE6OF01DTJKF.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgttgacacaccaaactacgcacagaagttccagggcagactcaccataaccgcggacaaattaacgaacacaagttaatactggagctagaacagcctgtcatctagaggacacgggcttctacttctgtgcgaggtagtaattactaataacactgtcttccttttacaccttcccttgtacttcgtcgggtcctacgtcggaaccccggtcgaccgtccc

SEQ ID NO: 103775 - DNA, 555 bp, Homo sapiens
  misc_feature: GYAE6OF01CQW1N.17.34.D01.1.454.CMB.1.raw
  modified_base (274)..(274): a, c, t, g, unknown or other
  misc_feature (274)..(274): n is a, c, g, or t
  modified_base (453)..(453): a, c, t, g, unknown or other
  misc_feature (453)..(453): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (531)..(532): a, c, t, g, unknown or other
  misc_feature (531)..(532): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaaccngtttcccatcgactacgcctttcggcctcgccttagggtcgactcaccctgccccgattaacgttggacaggaacccttggtcttccggcgagcgggcttttcacccgctttatcgttacttatgtcagcatttcgcacttctgatacctccagcatgcctcacagcacaccttcaacnggcttacagaacgctcccctaccaacaacgcaataagcgtcgctgccgcagcttcggtncatggtttanccccgtttnntctcccgcatctgactgtctacg

SEQ ID NO: 103776 - DNA, 546 bp, Homo sapiens
  misc_feature: GYAE6OF01E2OK1.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcccgatcgttgacacaccaaactacgcacagaagttccagggcagactcaccataaccgcggaacaaattaacgaacacagttaatctggagctagaacagcctgtcatctgaggacacgggcttctacttctgtgcgagagtaattactataacactgcttccttttacaccttcccttgaccttcgtcgggtccagtacggaaccccggtcgacccgtcc

SEQ ID NO: 103777 - DNA, 548 bp, Homo sapiens
  misc_feature: GYAE6OF01EN25P.17.34.D01.1.454.CMB.1.raw
  modified_base (382)..(382): a, c, t, g, unknown or other
  misc_feature (382)..(382): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaaggatcgtccctatcgttgacacaccaaactacgcacagaagtccagggcagactcacataccgngacaaattaacgaacacagttaatctaggagctagaacagcctgtcatctagagacacgggcttctacttctgtgacgaggagtaattactataacactgtcttaccttttacacccttccttcgacttcgtacgggtccacgtacggaaccccgtctacccgtcc

SEQ ID NO: 103778 - DNA, 556 bp, Homo sapiens
  misc_feature: GYAE6OF01APSQ6.17.34.D01.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
tcagcgtagactagcacgaccggtgctcgatttagatcgtctgtgttgggttggggagtcacgaaaacaaccgagattcctcctctaaagaagcccctgggagcacagctcatcaccatggactggacctggaggttcctctttgtggtggcagcagctacaggtgtccagtccccaggtccagttggtgcaatctggggctgaggtgaagacgcctgggtcctggtgagggtctcctgcaaggcttctggaggcaccttcagcgactatagtttcaattgggtgcgacgggcctcgtggacaaggccttgagtggatgggaaggntcgtcctagtcgttgacacaccaaactacgnacagaagtccagggcagacctcaccataaccgcggaacaaataacgaacacaagtaatctagagctagacagctgtcatctgagacacgggctcgtacttctgtcgcgaggtagtaattactatactactgtccttccttttacctcccttcccttgtaccttcgttacggggacctacgtccggtaccccggtacccg

SEQ ID NO: 103779 - DNA, 568 bp, Homo sapiens
  misc_feature: GYAE6OF01B8YH6.17.34.D01.1.454.CMB.1.raw
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagctagctacaggtgtccagtcccaggtccagttggtgcaatctggggctgaggtgaagacgcctgggtcctcggtggagggtctcctgcaaggcttctggaggcaccttcagcgactatagtttcaattgggtgcgacgggcctctggacaaggccttgagtggatggaaggatcggtccctatcgttgactacaccaaactacgcacagaaagttccagggcagactcaccataaccgcggaacaaatacgaacacagtaanctaganctagaacagcctagtcatctagacggacacgggcttctacttctgtgacgaggaattaattactataacactcgacttcctttttacacccttcccttcgacctttcgtacgggtcccagttacgggtaaccccgtccgtacccgttcccg

SEQ ID NO: 103780 - DNA, 550 bp, Homo sapiens
  misc_feature: GYAE6OF01CQEYM.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttcagggcagactcaccataaccgcggacaattaacgaacacagttaatactaggagctagaacagcctgtcatctgacgacacggtcttctacttctgtgcgaggagtaattactataactactgtcttaccttttacctaccttcccttgtaccttcgtcgggacctacgtcggtaaccccggtccg

SEQ ID NO: 103781 - DNA, 558 bp, Homo sapiens
  misc_feature: GYAE6OF01AZWAA.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtacgacgggcctctggacaaggccttgagtggatgggaaggatcgtccctatcgttgacacaccaaactacgcacagaatccagggcagactcaccataaccgcggaacaaattaacgaacacagttaatctagagctagaacagcctgtcatctgacggacgacgggtcttctacttctgtgcgaggagttaattactataacactgtccttaccttttaccacccttcccttcgtaccttcgtcgggcctacgtacggaaccccgtcacccgtctccc

SEQ ID NO: 103782 - DNA, 545 bp, Homo sapiens
  misc_feature: GYAE6OF01BSR1P.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctaggagctagaacagcctgtcatctgaggacacgggcttctacttctgtgcgaggagtaattactatacactcgtcttccttttactcccttcccttgtaccttcgtcgggccacgtcggtaccccggtccg

SEQ ID NO: 103783 - DNA, 545 bp, Homo sapiens
  misc_feature: GYAE6OF01CVQ8A.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactcgcacagaagttccagggcagactcaccataaccgcggacaaattaacgaacacagttaatctggagctagaacagcctgtcatctgaggacacgggcttctacttctgtgcgaggagtaattactatacactgtcttaccttttaccacccttcccttgtaccttcgtcgggacctacgtcggtaccccggtcccg

SEQ ID NO: 103784 - DNA, 554 bp, Homo sapiens
  misc_feature: GYAE6OF01DBQ2K.17.34.D01.1.454.CMB.1.raw
  modified_base (448)..(448): a, c, t, g, unknown or other
  misc_feature (448)..(448): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatgggaaggatcgtccctatcgttgacacaccaaactcgcacagaagttccagggcagactcaccataaccgcggacaaattaacgaacaacagttaatctaggagctagaacagcctgtcatctgaggacacgggnttctacttctgtgcgaggagtaattactataacactgtcttaccttttacacccttcccttgtaccttcgtcgggtcctattcggaaccccgttcgacccgttccc

SEQ ID NO: 103785 - DNA, 549 bp, Homo sapiens
  misc_feature: GYAE6OF01AH9BB.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactacgcacagaagttccagggcagactcaccataaccgcggacaaataacgaacacagttaatctggagctagaacagcctgtcatcgtgaggacgacggtcttctacttctgtgcgaggagttaattactataactactgtccttcttttacctccttcccttgtaccttcgtacggcctacgtccggtaccccgtccg

SEQ ID NO: 103786 - DNA, 554 bp, Homo sapiens
  misc_feature: GYAE6OF01CA2DT.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgaggggtctcctgcaaggcttctggaggcaccttcagcgactatagtttcaattgggtgcgacgggcctcgtggacaaggccttgagtggatgggaagatcgtccctatcgttgacacaccaaactacgcacagaagtccaggcagactcaccataacccgcggaacaaattaacgaacaacaagttaatctaggagctagaacagcctgtacatctgaggacgacggcttcctacttctgtcgcgtaggagtaattactataacactcgtcttccttttacctcccttcccttgtacttcgtcgggcctatccggaccccggtaccg

SEQ ID NO: 103787 - DNA, 545 bp, Homo sapiens
  misc_feature: GYAE6OF01AMU85.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaactacgcacagaagttccagggcagactcaccataaccgcggacaataacgaacacagttaatctggagctagaacagcctgtcatctgagacacgggcttctacttctgtcgcgaggagtaattactataacactcgcttccttttacacccttcccttgtaccgttctcgggtaccacgttcggaccccggttcccg

SEQ ID NO: 103788 - DNA, 722 bp, Homo sapiens
  misc_feature: GYAE6OF01EQ58A.17.34.D01.1.454.CMB.1.raw
  modified_base (668)..(668): a, c, t, g, unknown or other
  misc_feature (668)..(668): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgagtgagagcgcgtcggtccgtggtggaggtcctcgtgacgacgtcttcgtagggacgacttaccttagacggaccgtaacttaagtttacgttaactaagggttgggtcggaccgggaccgggtcctcggtacggaacgaacggttccgttaggaggtaggtaggtaggggaagtacgttccgtaccttagttcgtacgaaccaaccgaaacctaaacgtaccgaccaacgaaggttaaccgtaccggaacggacgaacgtacctaccaaacctaaacgtaacccggaacgtaaacttaaaacgtaaaccgaaacctaacgtaagttaactacggtacggactacgtacgaacgtcgtacctcgtactactcgtaggacgacggtaccggttcttacgttacttcgtaggtcgacggtagtaacttaacttactaaataactcgttcgttacccttttacctttaccncccttccgttacgttaccttcgggtaccggactacgggtaccccggtaaccccg

SEQ ID NO: 103789 - DNA, 542 bp, Homo sapiens
  misc_feature: GYAE6OF01DFOLX.17.34.D01.1.454.CMB.1.raw
  modified_base (259)..(259): a, c, t, g, unknown or other
  misc_feature (259)..(259): n is a, c, g, or t
  modified_base (498)..(498): a, c, t, g, unknown or other
  misc_feature (498)..(498): n is a, c, g, or t
tcagcgtagactagcacgaccggtgctcgatttagatcgtctgtgttgggtttggggatcacaaaacaaccagatttcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacggctctggacaaggccttgagtggagtgggaaggatcggtccctatcgttgacacaccaaactcgacacagaagttccagggcagactcaccataaccgcgacaaataacgaacacagttaatctggagactagacagcctgtcatctgaggacacggtcttctacttctgtgcgagtagtaattactataactatcgtcttccttttacnccttcccttgtacttcgtagggcctacgtcggtaccccggtccg

SEQ ID NO: 103790 - DNA, 545 bp, Homo sapiens
  misc_feature: GYAE6OF01BQKE5.17.34.D01.1.454.CMB.1.raw
  modified_base (322)..(322): a, c, t, g, unknown or other
  misc_feature (322)..(322): n is a, c, g, or t
  modified_base (514)..(514): a, c, t, g, unknown or other
  misc_feature (514)..(514): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtccctatcgttgacacaccaaactacgcaacagaagttccagggcagactcaccataaccgcggaacaaattaacgaacaacagttaatctaggagctagaacagcctgtcatctgagacacgggcttactacttctgtgcgaggagtaattactataacactgccttaccttttactcccttcccttntacttcgtcgggccagtcggaaccccggtcc

SEQ ID NO: 103791 - DNA, 552 bp, Homo sapiens
  misc_feature: GYAE6OF01AYQZM.17.34.D01.1.454.CMB.1.raw
  modified_base (324)..(324): a, c, t, g, unknown or other
  misc_feature (324)..(324): n is a, c, g, or t
  modified_base (500)..(500): a, c, t, g, unknown or other
  misc_feature (500)..(500): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggggaggcaccttcagcgactatagttcaattgggtgcgacgggcctcgtggacaaggccttgagtggatgggaagntcgtccctatcgttgacacaccaaactacgcaacagaacgtccagggcagactcacataccgcgaacaaataacgaacacagtaatctaggagctagaacagcctgtcatctgacgacgacggtcttctactctgtgcgaggtagtaattactatacactcgtcttccttttaccncccttcccttcgtaccttcgtacgggtacctacgtccggtaccccgtacccg

SEQ ID NO: 103792 - DNA, 608 bp, Homo sapiens
  misc_feature: GYAE6OF01ANPYI.17.34.D01.1.454.CMB.1.raw
  modified_base (255)..(255): a, c, t, g, unknown or other
  misc_feature (255)..(255): n is a, c, g, or t
  modified_base (316)..(316): a, c, t, g, unknown or other
  misc_feature (316)..(316): n is a, c, g, or t
tcagcgtagactagcacgaccggtgctcgatttagatcgtctgtgttgggtttggggacaaaacaaccagattcctcctctaaagaagccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacgggcctctggacaggccttgagtggatggaagntcgtcctatcgttgacacaccaaactcgcacagaattccgagggcagactcaaccactaaccggcggaactaaattacgaacactagtaatcgtagacgctagaacagtctcgtacacgtctggaaggaccgacgggtccttacgtacttcgtggtcgaccggtaaggaacgttaattacctaattaacgacgttactaccttacccgtttttacctacccttacccgttcgtaccttccgttacgggtacccgtacgtacccgggtaccccggtccgtacccggttacccg

SEQ ID NO: 103793 - DNA, 609 bp, Homo sapiens
  misc_feature: GYAE6OF01A5TJQ.17.34.D01.1.454.CMB.1.raw
  modified_base (188)..(188): a, c, t, g, unknown or other
  misc_feature (188)..(188): n is a, c, g, or t
  modified_base (545)..(545): a, c, t, g, unknown or other
  misc_feature (545)..(545): n is a, c, g, or t
tcagcgtagactagcacgaccggtgctcgatttagatcgtctgtgttgggtttgggggtacgatttgatgttacctgatgcgttagaggctttcctggaagcagggcatttgttgcttcagcacccgtagtgcctcgtcatcacggcctcgacgccttgattttcccggatttgccctggaaaacccngccctacccgcttaaaccgggcaaccgtcgcccggccaacatacgccttctccgtccccccttgcagtaacaccaagtacaggatataacctgttccatcgactacgcctttcggcctcgccttagggtcgactcaccctgaccccgattaacgttggactaggaacccttggtcttccggcgagccgggcttttccgacccgtcgtttactcggttacttagtcgttcagtcactttcgctacttctgactaccgtccagtcactcgcctcacctagccactaccttcactaggctttacagaaccgtcctacccctacaacacgcataacgcgtcgctcgccacacgcttcggtnctagttcggttaccgccccgtttcacttcccttacccggcctactccgacgtacctcgtcctcg

SEQ ID NO: 103794 - DNA, 619 bp, Homo sapiens
  misc_feature: GYAE6OF01CSCPV.17.34.D01.1.454.CMB.1.raw
  modified_base (537)..(537): a, c, t, g, unknown or other
  misc_feature (537)..(537): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattaacgtgacaggaaccttggcttccggcgagcgggtcttttcacccgtctttatcgttacttatgtcagctattcgcacttctgatacctccagcatcgcctcacagccaaccaccttcaacaggtccttaacagaaccgccctaccccctaacccaacaaccgacaactaaacgccgtccgctcgcccgcacgtccttcgggtcnccgtagttcgggtttaccgcccccgtttttacaccttcccgttccccgcctaattcccttaggacccttaggtcctaaccgg

SEQ ID NO: 103795 - DNA, 539 bp, Homo sapiens
  misc_feature: GYAE6OF01D2KQG.17.34.D01.1.454.CMB.1.raw
  modified_base (323)..(323): a, c, t, g, unknown or other
  misc_feature (323)..(323): n is a, c, g, or t
  modified_base (384)..(384): a, c, t, g, unknown or other
  misc_feature (384)..(384): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatttgggtgcgacgggcctctggacaaggccttgagtggatgggaagntcgtcctatcgttgacacaccaaactcgcacagaagttccagggcagactcacataaccgngacaaataacgaacacagtaatctagagctgaacagcctgtcatctgagacacggcttctacttctgtgcgaggagtaattactataacactgtcttaccttttacaccttcccttgtaccttcgtacgggtacctagtcggtaaccccggtccg

SEQ ID NO: 103796 - DNA, 639 bp, Homo sapiens
  misc_feature: GYAE6OF01AOOG2.17.34.D01.1.454.CMB.1.raw
  modified_base (347)..(347): a, c, t, g, unknown or other
  misc_feature (347)..(347): n is a, c, g, or t
tcagcgtagactagcacgaccggtgctcgatttagatcgtctgtgttggggtttgggggatcaacaaaacaaccagattcctccgtctaaaagaagcccctgggaggcacagctccatcaccattggactggacctggaggttcctctttgtggtggcagcgagctacaggtgtccacgtcccaggtccagttggtcgcaatcgtggggctggaggtgaagacgcctgggtcctcggtgagggtcctcctgcaaggcttcgtgggtaggcaccttcagacgaactatagtttcaagttgggtgccgacgggcctcgtaggacaacggccttgagtggatgggaagtntcgtccctagtcgttagaccaccgacctaaaccgtaccgcaacagtaacgttccgagggccaggtaccgtaccaaccgaacgtaacccggcggtaaccaaaacttaaccgaaccaactaacgttaatcgtaggacgacgtagaaccacgtcctagtacatcgtggaggtaccgtacggtcttctactctgtgacgtagtactaattactactaacctacgtacgtccttaccttttaccacccttaccgttagtaccttacgtacgggtacctacgtccggtaccccgtccg

SEQ ID NO: 103797 - DNA, 559 bp, Homo sapiens
  misc_feature: GYAE6OF01D3G2T.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaaggatcgtcctatcgttgacacaccaactacgcacagagttcagggcagactcaccataaccgcgaacaaattaacgaacacagttaatctggagctagaacagcctgtacatctagaggacacgggcttctacttctgtgcgaggagtaattactaatactactcgtccttaccttttactacccttcccttgacctttcgtcgggtcctagtaccggtaaccccggtcgtacccgtcccg

SEQ ID NO: 103798 - DNA, 553 bp, Homo sapiens
  misc_feature: GYAE6OF01B6J7V.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttggagtggatgggaaggatcgtccctatcgttgacacaccaactacgcacagaagtccagggcagactcaccataaccgcgaacaaataacgaacacagtaatctaggagctagaacacgcctgtcatctgaggacacggcttctacttcgtgtgcgagtagtaattactataacactacgtcttaccttttacctccttcccttcgtaccttcgtcgggtacctacgtccggtaaccccggtccg

SEQ ID NO: 103799 - DNA, 559 bp, Homo sapiens
  misc_feature: GYAE6OF01EWHFX.17.34.D01.1.454.CMB.1.raw
  modified_base (405)..(405): a, c, t, g, unknown or other
  misc_feature (405)..(405): n is a, c, g, or t
tcagcgtagactagcacgaccggtgctcgatttagatcgtctgtgttgggtttggggagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggaacaaattaacgaacacagttaatctagganctagaacagcctgtcatctgaggacacgggcttctacttctgtgcgaggtagtaattactataacactgtcttaccttttaccaccttcccgttgtacttcgtcgggtcctacgttacggtaacccccggttcacccgttctcccgtcctaccg

SEQ ID NO: 103800 - DNA, 546 bp, Homo sapiens
  misc_feature: GYAE6OF01EHMNO.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtctcaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggatcgtccctatcgttgacacaccaaactacgcacagaagttccagggcagactcaccataaccgcgaacaataacgaacacagttaatctggagctagaacagcctgtcatctagagacacgggcttctacttctgtgcgaggtagtaatactataacactcgtcttccttttaccaccttcccttacgtaccttcgtacgggtcctagtcggtaacccccgg

SEQ ID NO: 103801 - DNA, 548 bp, Homo sapiens
  misc_feature: GYAE6OF01AY02R.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcgggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcgacaaattaacgaacacagtaatctaggagctgaacagcctagtcatcgtgaggacgacggcttctacttctgtgcgaggagtaattactataacactgtcttccttttacaccttccttcgtacttcgtcgggtccacgtcggtaccccggtcgtcccgtcc

SEQ ID NO: 103802 - DNA, 545 bp, Homo sapiens
  misc_feature: GYAE6OF01EK0RZ.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgtgacacaccaaactacgcacagaagtccaggcagactcacataaccgcggaacaataacgaacacagttaatctaggagctagaacacgcctgtcatctgacggacacgggcttctacttctgtgcgaggagtaattactataactactcgtcttacctttacctccttcccttgtacttcgtcgggacctacgtcggtaccccggtacccg

SEQ ID NO: 103803 - DNA, 553 bp, Homo sapiens
  misc_feature: GYAE6OF01CW0B3.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgaggggtctcctgcaaggcttctggaggcaccttcagcgactatagtttcaattgggtgcgacgggcctctggacaaggccttgagtggatgggaagatcgtccgatcgttgacacaccaaactacgcacagaagttccagggcagactcaccataaccgcggaacaaattaacgaacacagttaatctaggagctagaacagcctgtcatctgaggacacgggcttctacttctgtgcgaggagtaattactataacactgtcttccttttacacccttcccttcgtaccgttctcgggtcctacgtacggaaccccggtcgcccgtcc

SEQ ID NO: 103804 - DNA, 569 bp, Homo sapiens
  misc_feature: GYAE6OF01CUZ6O.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttctggaggcaccttcagcgactatagtttcaattgggtgcgacgggcctctggacaaggccttgagtggatggagatcgtcctatcgtgacacaccaaactacgcacagaagttccaaggcaagactcaaccataaccgacggaacaaaattaacgaacacaagttaatctaggagactagaacagctagtcatctgacggacacgggtcttacgtaccttcgtgtagtcgaggtagttaattactaataactactgtacttccgttttaccaccttcccttcgtacttcgtcgggtcctagtacggtaccccgtcgaccgttaccc

SEQ ID NO: 103805 - DNA, 590 bp, Homo sapiens
  misc_feature: GYAE6OF01DA4OP.17.34.D01.1.454.CMB.1.raw
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggngcgacgggcctctggacaagggtccttgagtggatgggaaggatcgtccctatcgttgacacaccaaactcgcacagaagttccagggcagactcacataaccgcggaacaattaacgaacactaagttaatctaggagactagaacagcctgtcatctagaggacgacgggtcttctacttctgtcgcgaaggagttaattaactaataacgtactcgtacctttaccctttttaaccacccttcccgtttacgtaccgtttaccgtacggggtaccctacgtccgggtaacccccggttaccccg

SEQ ID NO: 103806 - DNA, 576 bp, Homo sapiens
  misc_feature: GYAE6OF01DGQNY.17.34.D01.1.454.CMB.1.raw
tcagcgtagactagcacgaccggtgctcgatttagatcgtctgtgttgggtttgggggatcgacaaaacaaccagattccccctctaaagaagcccctgggagcacagctcatccaccatggactggacctggaggttcctctttgtggtggcagcagctacaggtgtccagtcccaggtgcagctggtgcagtctggggctgaggtgaagagccgtggggcctcagtgaaggtctcctgcaaggcttctggattcacgtttacctctatagttatcaactgggtgcgccaggccgctagggaccaacgcctggacgtggatgggatgggacgaaaccctacacgttggtgtcacagtgtacttccaccctatcccgtccgggacagtaccttaccgatcgacctacgaaccttcccacctaataaaccacagtcctaacatggaattgagtagcctagacatctacgaacgaccgacggtcccgtcttaacttactggttcgcgtacgacggtcccaacgagtaccgggtgacgcctaacgggcaggtccggtccttgaccttggtcgggacccg

SEQ ID NO: 103807 - DNA, 618 bp, Homo sapiens
  misc_feature: GYAE6OF01CZRBD.17.34.D01.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggattcacgtttacctcctatagtatcaactgggtncgccaggccgntggacaacgcctgagtggatgggatgggacgaaccctanactggtntcacgagtgtcttcacccatccctccggacagtacttaccatcgaccacgaactcctaccaataacacacgacctacagtaggtagttagaaggtagccttagactacgtacgtagaacgacgaccgggtcccgttacttaacgttaacgtcggttacgaccgtagaccggttacccaacggtacgttcccgggtagacggtacccgtacgggacacggtcccggtccttttcggaccgtttcggtacgggggaccaacggggtcgtcccccggttacggg

SEQ ID NO: 103808 - DNA, 540 bp, Homo sapiens
  misc_feature: GYAE6OF01DB80H.17.34.D01.1.454.CMB.1.raw
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcggacgggcctctggacaaggccttgagtggagtgggagatcgtcctatcgtgacacacaaactcgcacagacgtcaggcagactcacatacgngacaatacacacagtancgtganactagacagctgtcatcgtgagacgacggtcttactacttctgngcgagtataatactaanactatcgtcctttaccttttacctcccttacccttagtaccgttcgtacgggtaccacgtccggtaccccggtacccg

SEQ ID NO: 103809 - DNA, 538 bp, Homo sapiens
  misc_feature: GYAE6OF01E4OLY.17.34.D01.1.454.CMB.1.raw
  modified_base (282)..(282): a, c, t, g, unknown or other
  misc_feature (282)..(282): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtncgacgggcctctggacaaggccttgagtggatgggaagatcgtccctatcgttgacacaccaaactacgcacagaacgttccagggcagactcaccataaccgcggacaaattaacgaacacagttaatctaggagactgaacagcctgtcatctgaggacacggcttctacttcgtgtgcgagagtaatactataacactgtctaccttttacacccttcccttgtacttcgtcgggaccagtcggacccgtccg

SEQ ID NO: 103810 - DNA, 574 bp, Homo sapiens
  misc_feature: GYAE6OF01EU0W3.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggcccttgaggtggatggggaaggatcgtccctatcgttgacacaccaaactacgcacagaagttccagggcagactcacataaccgcgacaaataacgaacacaagttaatctaggagctagaacagcctgtcatctgacggacacgggcttctacttctgtgtcgaggtagtaattacgtaataacgtactgtccttccgtttttacctacccttcccttcgtaccttcgtcgggtcctacttaccggaaccccggtcctacccggttacccg

SEQ ID NO: 103811 - DNA, 576 bp, Homo sapiens
  misc_feature: GYAE6OF01DFLCA.17.34.D01.1.454.CMB.1.raw
  modified_base (521)..(521): a, c, t, g, unknown or other
  misc_feature (521)..(521): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgaactatagtttcaagttgggtgcgacgggcctcgtggacaaggccttgagtggagtgggaggatcgtcctatcgttgacacaccaaactacgcacagaacgtccaggcagactcacataaccgcgaacaaataacgaacaacaagttaatcgtagagctagaacagcctagtcatctaaaagcggacgacgggtcttacttacttgtgtgacgtaaggtataattaactaataactactgtaccttaccttttaccncccttcccttacgtacgtttcgtacgggtcctaacgtccggtaaccccggtcccg

SEQ ID NO: 103812 - DNA, 546 bp, Homo sapiens
  misc_feature: GYAE6OF01CYDE6.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactcgcacagaagttccaggcagactcacataaccgcgacaataacgaacacagttaatctaggagctagaacagcctgtcatctgaggacacgggcttctacttctgtgcgaggagtaattactataactactcgtcttccttttacacccttcccttgtacctttcgtacgggtcctacgtcggaaccccggtaccg

SEQ ID NO: 103813 - DNA, 591 bp, Homo sapiens
  misc_feature: GYAE6OF01AYP0M.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatggggaaggatcgtccctatcgttgacacaccaaactacgcacagaagtcagggcagactcacataccgcggaacaaattaacgaacacagttaatctaggagactagaacgagcctgtacatctagagacacgggtcttcgtacttcgtgtacgcggaaggtagtaacttactaataacctacttcgtacctttcccgtttttaacctacccttacccttcgttaccttcgtacggggtcctacgttaccgggacccccggttcctacccggttcccc

SEQ ID NO: 103814 - DNA, 685 bp, Homo sapiens
  misc_feature: GYAE6OF01CTOOC.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcgaaggcttcgtggaggcaccttcagcgactatagtttcaagttgggtgcggacgggcctcgtggacaaggtccttggagtggatggggaagatcgtcctatcgttgacacacaaactcgcaacagaacgtccgaggcagactacaaccataaccgacgaactaaattaacgaacaactaagttaactacgtaggaacgacgtaacgaaacgacgaccgttagtacgtactacgtaggaacggaccgaccgggttaccttaccgttacgttcgtcggttacggacgtaaggtacggttaaacttaacgttaacgtaaaccgtacgttacggttaccctttacccttttttaacccgtacccctttaccccgtttacggttaacccgtttccgggttaccggggtacccttaaccggttacccgggtaaccccccggtttaaccccgg

SEQ ID NO: 103815 - DNA, 550 bp, Homo sapiens
  misc_feature: GYAE6OF01D8VWI.17.34.D01.1.454.CMB.1.raw
  modified_base (501)..(501): a, c, t, g, unknown or other
  misc_feature (501)..(501): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggaacaaattaacgaacacagttaatctaggagctagaacagcctgtcatctgaggacacgggtcttctacttctgtcgcgaggtagtaattatataacactgcttccttttacncccttccttagaccttcgtacgggtacctacgtcggaccccggtacccg

SEQ ID NO: 103816 - DNA, 533 bp, Homo sapiens
  misc_feature: GYAE6OF01B0KOM.17.34.D01.1.454.CMB.1.raw
  modified_base (386)..(386): a, c, t, g, unknown or other
  misc_feature (386)..(386): n is a, c, g, or t
  modified_base (436)..(436): a, c, t, g, unknown or other
  misc_feature (436)..(436): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactcgcacagaacgttcaggcagactcaccataaccgngaacaaataacgaacacagttaatctaggagctagaacagcctgtcatcngagacacggcttctacttctgtgcgagtataatactataacatgtcttcctttacncccttcctntacttcgtcgggacctacgtcggacccgtccg

SEQ ID NO: 103817 - DNA, 1114 bp, Homo sapiens
  misc_feature: GYAE6OF01CVUM2.17.34.D01.1.454.CMB.1.raw
  modified_base (113)..(113): a, c, t, g, unknown or other
  misc_feature (113)..(113): n is a, c, g, or t
tcagcgtagactagcacgaccggtgctcgatttagatcgtctgtgttgggtttggggatcacaaaacaaccagattcctcctctaaagaagcccctgggagcacagctctacnccactagtcgtacgcggcgtaggtaccgttcctttcgtttgggtgggtcggacgacgacgacgtacctaacggtagggttccgtaccgtacccgtacccggtaccggttaccgttagggtttgggcgaactaacgttcggggtcggggtcgtaggggtagggtaacggaaccggacccggtccgggtttcccggggttacccggttcgggggttaagggggtacccggggtttccccttccggtacggaaaccggtaaccgggtttccttttcgggagggggaccgtaccccttacccgttacggaaccggtaccgttaaactttaaggttttaccgtttaaacggttaaggggttttcgggggaccgggtacccgggggtaccccgggttcccgttcggggtaaccgggtaaaccgggtaaccgggtttaccggtttaaggggtaggggttaacggggtaagggggtaaaggggggtaacggttacccggtttcccccggtttaacccgtttacgggtttaccgggttaaccgaaaaccctaaaccccgaaaaaccctaaaccggtaccgaaccgaaacgtaaacgggttaacccggtaccggggaacggaaccgaaccgtaaccctaccctaaaccgtaaaaccccggtacccggaaaccggtaaaacttaaaaccggtaaacccgaaccgttaaacggttaaacgtttaaccgtacgggtaacgggaaccttacgtaaacgaccgtaccgtacgtttaccgtactacgtaccggtaagggaaccggtaaccgggtcggttttacctttaccgttaccgttacggtgggtaccggaagggtaacggttaagtttaacccttaaactaaaccgtaccgttacgttaccgttttaccctttttaacccgtttaaccctccccgttttaccgttagtttccccgtttacggggaccggttacctaacccggggtaaccccccgggttaccccgttaccccgg

SEQ ID NO: 103818 - DNA, 553 bp, Homo sapiens
  misc_feature: GYAE6OF01D9CMD.17.34.D01.1.454.CMB.1.raw
  modified_base (430)..(430): a, c, t, g, unknown or other
  misc_feature (430)..(430): n is a, c, g, or t
  modified_base (506)..(506): a, c, t, g, unknown or other
  misc_feature (506)..(506): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaaggccttggagtggatgggaagatcgtcctatcgttgacacaccaaactacgcacagaacgtccagggcagactcaccataaccgcgaacaaattaacgaacacaagttaatctaggagctagaacancctgtacatctagaggacacgggtcttctacttctgtgacgtaggataatactataacactgtcttaccttttacnccttcccttcgtacttcgtacgggacctacgtccggaccccggtacc

SEQ ID NO: 103819 - DNA, 599 bp, Homo sapiens
  misc_feature: GYAE6OF01C4UVR.17.34.D01.1.454.CMB.1.raw
  modified_base (444)..(444): a, c, t, g, unknown or other
  misc_feature (444)..(444): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaggcttcgtggaggcaccttcagcgactatagtttcaagttgggtgcgacgggcctcgtggactaaggccttggagtggagtgggaagtatcgtaccctagtcgttagacacacaaactcgacacgagaacgtcgaggcagactcaaccagtaaccgacgaacaaactaacgaacataagtaactcgtagacgtacgtagaacncgactgtacatcgagacgacgacggtcttactacttcgtgtagacgtaaggtacttaattactaataacctactacgtcctttacccttttacctccccttaccgttcgtaccttccggtacgggtacctaacggtcccgggtaaccccgtaccg

SEQ ID NO: 103820 - DNA, 609 bp, Homo sapiens
  misc_feature: GYAE6OF01CR92T.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcgggtgagggtctccgtgcaaggcttcgtggaggcaccttcagcgactatagtttcaagttgggtgcggacgggcctcgtggacaaggtccttgagtggatgggaagatcgtcctagtcgtgacacgaaccaaactacgacaacaagaacgttccaagggcagactcaaccaagtaacccgacggaacaaaagttaaccgaacaactaagttaactctaggacgcgtagaacacgtcctagtcatcgtagacggacgacgggtcttactacttctggtcgtacgtaggtagttaattactaactaactactacgtcttaccttttacctaccctttccttcgtaccgttcgtacgggtcctacgtaccggtaccccgtcgtacccgttcccg

SEQ ID NO: 103821 - DNA, 545 bp, Homo sapiens
  misc_feature: GYAE6OF01B3QJS.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctagtcgttgacacaccaaactacgcacagaagttccaggcagactcaccataaccgcgacaaataacgaacacaagttaatactaggagactagaacagcctgtcatctgaggacacgggcttctacttctgtgcgagagtaattactatacactgtcttccttttactcccttcccttgacttcgtacgggcctacgtcggaccccggtacccg

SEQ ID NO: 103822 - DNA, 559 bp, Homo sapiens
  misc_feature: GYAE6OF01DFL94.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaccggcttcgtggaggcaccttcagcgactatagtttcaagtttgggtgcggacgggcctcgtggacaaggtccttggaggtggagtgggaaggatcgtcctatcgtgacacaccaaactcgcacagagtcaggcagactcacataccgcgaacaataacgaacacagtatctagagctagaacagctgtacatctgacggacacggtcttactacgttctgtgcgtaggtagtaattactactaactacttcgtcctttaccttttaccacccttcccttgtaccttcgtcgggacctacgtccggaccccggtacccg

SEQ ID NO: 103823 - DNA, 556 bp, Homo sapiens
  misc_feature: GYAE6OF01ECQYV.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtgggatggggaagntcgtccctatcgttgacacaccaaactcgcacagaagttccagggcagactcaccataaccgcggaacaaataacgaacacaagttaatctaggagactagaacagcctgtcatctgaggacacgggcttctacttctgtgcgaggagtaattactataactactgtccttaccttttacctcccttcccttgtaccttcgtcgggacctacgtcggtaaccccggtaccc

SEQ ID NO: 103824 - DNA, 572 bp, Homo sapiens
  misc_feature: GYAE6OF01DFSGY.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggctctggacaaggccttgagtggatgggaagatcgtccctatcgttgacacaccaaactacgcacagaacgttccggggcacgactcaccaataaccgcggaacaaacttaacgaacacagttaaactctaggagctagaacagcctgtcatctggacggacacgggtcttctacttcgtgtgcgagagttatactaataacactgtcttaccttttaccacccttcccgttcgtaccttcgttcggggtaccctacgttaccgggaccccgtcctaccccgg

SEQ ID NO: 103825 - DNA, 536 bp, Homo sapiens
  misc_feature: GYAE6OF01AUZQ1.17.34.D01.1.454.CMB.1.raw
  modified_base (249)..(249): a, c, t, g, unknown or other
  misc_feature (249)..(249): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (407)..(407): a, c, t, g, unknown or other
  misc_feature (407)..(407): n is a, c, g, or t
  modified_base (489)..(489): a, c, t, g, unknown or other
  misc_feature (489)..(489): n is a, c, g, or t
tcagcgtagactagcacgaccggtgctcgatttagatcgtctgtgttgggtttggggatcacaaaacaaccagattccctcctctaaaagaagcccctgggagcacagctcatcaccatggactggacctggaggttcctctttgtgggtggcagcagctacaggtgtccagtcccaggtccagttggtgcaatctggggctgaggtgaagacgcctgggtcctcggtgagggtctcctgcaggcttcnggaggcaccttcagcgactatagtttcaattgggtgcgacgggcctcgtggacaaggccttgagtggatgggaaggntcgtccctatcgttnacacaccaactacgcacagaagtccagggcagactcacatacgcgacaatacacacatatctaganctagacagctgtcatctgagacgacgggtcttctacttctgtgcgaggtataattactataacactcgtcttaccttttacncccttccttctaccttcgtcgggtaccacgtccggtacccggtaccg

SEQ ID NO: 103826 - DNA, 542 bp, Homo sapiens
  misc_feature: GYAE6OF01CN7M4.17.34.D01.1.454.CMB.1.raw
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
  modified_base (497)..(497): a, c, t, g, unknown or other
  misc_feature (497)..(497): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaagntcgtcctatcgttgacacaccaaactacgcacagaagttccagggcagactcaccataaccgngaacaaataacgaacacagtaatntgagctagacagcctgtcatctgagacacggcttctacttctgtgacgtaggagttaactactataactactcgtcttccttttacncccttcccttagtacttcgtcgggctacgtcggaaccccggtccg

SEQ ID NO: 103827 - DNA, 641 bp, Homo sapiens
  misc_feature: GYAE6OF01CW00Q.17.34.D01.1.454.CMB.1.raw
  modified_base (249)..(249): a, c, t, g, unknown or other
  misc_feature (249)..(249): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgccgtgggtcctcggtgagggtctcctgcaaggcttcgnggacggctacttcagcgactatagtttcaagttgggtgcgacgggcctcgtggacaggccttggagtggagtagggaagtactcgtacctagtcggttagaactacaaccaaactcgacaacgagaacgtccgaagggcaagacctacaccaagtaacccgagaacaaataacgaacaactagttaactcgtaggacgtactacgacacgtactagactactcgtagaggaccgcggttcttcgttaccgttctaggtgtacggtaaggtagttaacgttactaacgtaactaccttacgtccctttaacccgttttacccaccctttacccgttcgttaacccgtttcggtacgggtaccctaccggttaccggtaaccccggttaccccg

SEQ ID NO: 103828 - DNA, 563 bp, Homo sapiens
  misc_feature: GYAE6OF01EA9NE.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaattaacgaacacaagttaatctaggagctagaacagcctgtcatctgacggacacgggtcttctacttctgtgcgtaggagttaattactataacactgtccttccttttacctacccttcccttcgtaccttcgtcgggtcctacgtaccggaaccccggtcgcccgtccc

SEQ ID NO: 103829 - DNA, 562 bp, Homo sapiens
  misc_feature: GYAE6OF01B5R5M.17.34.D01.1.454.CMB.1.raw
  modified_base (416)..(416): a, c, t, g, unknown or other
  misc_feature (416)..(416): n is a, c, g, or t
  modified_base (508)..(508): a, c, t, g, unknown or other
  misc_feature (508)..(508): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactcgcacagaacgttccagggcagactcaccataccgcgacaattaacgaacacagttaatctagganctagaacagcctgtcatctgaggacacggtcttactacgttctgtgcgaggtagtaattactataacctacttcgtcctttaccttttaccncccttcccttagtaccttcgtacgggtaccctacgtccgggtaccccggtcccg

SEQ ID NO: 103830 - DNA, 606 bp, Homo sapiens
  misc_feature: GYAE6OF01A8BK1.17.34.D01.1.454.CMB.1.raw
  modified_base (418)..(418): a, c, t, g, unknown or other
  misc_feature (418)..(418): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgtggacaggaacccttggtcttccggcgagcgggcttttcacccgtctttatcgttacttatgtcagcattcgctacttcngactacctcagcatcgcctcacacgcacaccttcacacgtacttacacgaaccgtccctacccctaacccaacaaccgcaactaacgccgtccgctcgccgacacgtcgttcggtcgctagttcggtttaccgtccccgtttcacttcccgttccccgacctacttcctagaccttacgtccgtaccg

SEQ ID NO: 103831 - DNA, 553 bp, Homo sapiens
  misc_feature: GYAE6OF01EKETT.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagaagcctggggcctcagtgaaggtctcctgcaaggcttctggattcacgtttacctcctatagtatcaactgggtgcgccaggccgctggacaacgacctgagtggatgggatgggccgaaccctaacacgtggtgtcacagtgtcttcacccatcccgtccgggacacgtactacatcgaccacgaactcctaccaataacacacgacctacatggagttgaggagcatgacatctagacgacgacggcctctattactgtgcgtagacgtcccacgtacgtccggtgacgcccgtacggccacggccggtcctttcgaccgttcggcggggcccgtaggggtacccg

SEQ ID NO: 103832 - DNA, 555 bp, Homo sapiens
  misc_feature: GYAE6OF01CMVVX.17.34.D01.1.454.CMB.1.raw
  modified_base (322)..(322): a, c, t, g, unknown or other
  misc_feature (322)..(322): n is a, c, g, or t
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaaccaaactacgcacagaagttccagggcagactcaccataaccgngaacaataacgaacacaagtaatctagagctagaacacgcctgtcatctagacggacgacgggtcttctacttctgtgacgagagtaattactactaactactagtccttaccttttacctcccttacccttcgtacttcgtacgggcctacgtcggaaccccgtcccg

SEQ ID NO: 103833 - DNA, 562 bp, Homo sapiens
  misc_feature: GYAE6OF01DEZS0.17.34.D01.1.454.CMB.1.raw
  modified_base (419)..(419): a, c, t, g, unknown or other
  misc_feature (419)..(419): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtccaaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtcggatgggaacgagtcgtacctatacgtgacacacaaactcgcacagagtccgaggcagactcgacataaccgcgaactaataacgaacactaagttaatctagganactagaacagcctagctatctgacgacgacgggtcttcctacgttcgtagtgacgaggtagtaacttaactataactactgtcttaccctttttacacccttaccttgtacttcgcgggtacctacgtccggaccccgtaccg

SEQ ID NO: 103834 - DNA, 578 bp, Homo sapiens
  misc_feature: GYAE6OF01BWRQZ.17.34.D01.1.454.CMB.1.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (523)..(523): a, c, t, g, unknown or other
  misc_feature (523)..(523): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaagttgggtgcgacgggcctcgtggacaaggtccttgagtggagtgggaagatcgtcctagtcgttgacacaccaaactacgcacgagaagttccaggcagactcacataaccgcgaacaaattaacgaacacagttaacnctaggancgtagaacacgcctgtactatcgtagagaccgacggtcttactacttcgtggtacgacgtagtagtaacttactaatacgtactcgtcctttacctttaccncccttacccgttagtacctttcgtcgggtacctacgtccggtaaccccggtcccg

SEQ ID NO: 103835 - DNA, 1062 bp, Homo sapiens
  misc_feature: GYAE6OF01B1Z8O.17.34.D01.1.454.CMB.1.raw
tcagcgtagactagcacgaccggtgctcgatttagatcgtctgtgttaggggttgggacaaaacaaccagattccgtcctcgtaaagaagccccctagggagcgactagcctcactcaccctatggtacctggaccttggacggttcctcgtttggtggtggctagcctaggccgtactaggttgtcccagttcccacggtccacgttggtcgcgtaatcgtgggctggaggtgaacgaccgcctgggtaccctgggtgacggggtcctcccgtgacgtaaggttcctttaccgtcgggacggacctaacccgtttcgaacggtaccgtaaccttaacgttaacggttttaccaaaacgttttacggggtaacgtaccgggtaaccggggtaccccgttccgtttccggggtaaccgaaaacggggtcccccgttttaggaaccggttggggtaacgttttacggggggaaacggggttacgtttacccggggttaccccccggttaaaacgtttccccggggtttttacggggaacccctaacccgaaaacccccggttaaaaaaccgttttacccgggaaccgttaaacccgaaacgggtaaaacgggttttacccccgaaacggggggtaccctaacgggtaaacccgttttacccgaaaccccgtttaaaccgttaaaacccccgggacccgggtaaaacccctaaaaaacgttttaaacccgggaaaaccccgtaaaccgtaacccggtttttaaaaaccgttaccggttaacgggtaaccggtacccgtttaaacgggaaacccgtaacgggttaccccgttacggtttaacccgttaacgtttaccgttacgggtaacggtaaccgtaaccgggtacctttaccgtttaacgtttccgttacgttacggtccgttaacgggttacggttaacgttacgtaacgtaaacgtacttacggtacctttaccgttttaaccgaccctttacccgttcgtacgtttaccgttcgggtaccctacggttaccggtaccccggttccgtcccggttaccccg

SEQ ID NO: 103836 - DNA, 629 bp, Homo sapiens
  misc_feature: GYAE6OF01DFIFH.17.34.D01.1.454.CMB.1.raw
  modified_base (259)..(259): a, c, t, g, unknown or other
  misc_feature (259)..(259): n is a, c, g, or t
tcagcgtagactagcacgaccggtgctcgatttagatcgtctgtgttgggtttaggggacaaaacaaccagattcctcctctaaagaagcccctgggagcacagctcatcaccatcggactggacctggaggttcctctttgtggtggcagcagctacaggtgtccagtccccaggtccagttggtgcaatcgtggggctggaggtgaagacgcctgggtcctcggtgagggtctcctgcaaggcttctggagcacctnagcgactatagttcaattgggtgcgacggcctcgtggacaaggcttgagtggatgggaagatcggtcctatcgtgacacaaccaatacgcacagtaacgtcagggcagactcaccataaccgcgaactaaaagtaacgaacaactaagttaactacgtaggagactagaacgagccgtgtacatcgtagacgtacacggtcttactactttcgtagtagacgtaaggtaacgttaattacgttaattaaaccgtaccgtacgtactttacccgtttttaaccacccctttacccgttacgttacccgtttccggtacgggtacccgtaacgttaccgggtaaacccccggttccgtaccccggttccccg

SEQ ID NO: 103837 - DNA, 630 bp, Homo sapiens
  misc_feature: GYAE6OF01EK9F3.17.34.D01.1.454.CMB.1.raw
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaagtgcccactcccaggtgcagctggtgcagtctgggctgaggtgaagagccgtggggcctcgagtgaaggtctcctgcaaggcttcgtggattctacgtttacctctatagtatcaacgtgggtgccgccgaggccgcgtggaccaacggcctggacgtggagtgggatcggggacctaaaccctaacgacgtggtcgtaccaacgtaggttcgttaccttaccacccctacgtcccgtaccgggaacacgtaccttaccagtacgaacccacgtaaccctccctaccaactaaaccncaacgcctaanagtggtagttgagtacncctagactagtctaggaccgacgaccggtccttactagttaccgtgtcgacgaagtcccgtacccgaacggtacgtccgggacggcgtacccgtacgggccgtacggtcccggttaccgttttacgccgttcgggtacccgggg

SEQ ID NO: 103838 - DNA, 555 bp, Homo sapiens
  misc_feature: GYAE6OF01C4HE7.17.34.D01.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncgacgggcctntggacaaggccttgagtggatgggaagatcgtccctatcgttgacacaccaaactcgcacagaagtccagggcagactcacataaccgcggaacaaattaacgaacacagttaatctagagctagaacagcctagtcatctagaggacacgggcttctacttctgtgcgaggagttaatactaataacactgtccttaccttttacacccttcccttgtaccttcgtacgggtccagtaccggaaccccgtcgtacccggttcc

SEQ ID NO: 103839 - DNA, 570 bp, Homo sapiens
  misc_feature: GYAE6OF01ES5LA.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaagggccttgagtggatgggaaggatcgtccctatcgttgacacaccaaactacgcaacagaagttccagggcagactcaccataaccgcggaacaaattaacgaacacaagttaatctaggagctagaacacgacctgtacatctagaggacacgggtcttctacttcgtgtgcgaggtagtaattactaataactacttcgtcttaccttttactaccttcccttgtaccttctacgggtcctacgtaccggtaaccccgtcctacccgtcc

SEQ ID NO: 103840 - DNA, 595 bp, Homo sapiens
  misc_feature: GYAE6OF01BBP8P.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggagtgggaaggatcgtcctatcgttgacacaccaaactacgcacagaagtccagggcagactcaccataaccgcggaacaaattaacgaacacaagttaactcgtaggagactagaacagacctgtacactcgtagaggacacgggtcttctacttctgtgacgtaggtaagttaattacgtaattaaccacttacgtcctttacccgttttacctacccttcccttcgtacctttcgtacgggtaccctacggttaccggaaccccgttccgtacccggttcccg

SEQ ID NO: 103841 - DNA, 541 bp, Homo sapiens
  misc_feature: GYAE6OF01CFF3S.17.34.D01.1.454.CMB.1.raw
  modified_base (492)..(492): a, c, t, g, unknown or other
  misc_feature (492)..(492): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggcctctggacaggccttgagtggatgggagatcgtcctatcgtgacacaccaaactcgcacagagtccaggcagactcacataaccgcgaacaataacgaacacagtaatcgtagagctagaacagcctagtcatctagagacgacgggtcttctacttctgtgcgaggagtaattactataactactcgtcttaccttttacncccttcccttacgtacttcgtcgggtacctacgtcggtaccccggtccg

SEQ ID NO: 103842 - DNA, 567 bp, Homo sapiens
  misc_feature: GYAE6OF01AM94J.17.34.D01.1.454.CMB.1.raw
  modified_base (283)..(283): a, c, t, g, unknown or other
  misc_feature (283)..(283): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncgacggctctggacaggccttgagtggatgggaagatcgtccctatcgtgacacaccaaatcgcanagaagttccagggcagactcaccataaccgnggaacaaataacgaacactagttaatctaggagactgaacagcctagtcatctacgaggacacgggcttactacttctcgtagtacgaggaagttaattacgtataaacctacttacgtccttacccttttacacccttccctttacgacctttcggtacgggacctacgtcggtaccccgttaccg

SEQ ID NO: 103843 - DNA, 595 bp, Homo sapiens
  misc_feature: GYAE6OF01D8IJV.17.34.D01.1.454.CMB.1.raw
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacccgacttaaaccgggacaaccgtcgcccggccaacatacgccttcctcccgtcccccttcgcagtaacaccaagtacaggaatattaacctgtttccatcgactacgcctttcggcctcgccttaggggcactcaccctgcccgattaacgtgacaggacctgctccggcagcggctttcacccgtntttatcgttacttatgtcagctatcgctacttctgaacttacctcagacactgccctnacagcacaccttcacgagccttaacgagtaacccgccctacccctaacccaacaaccgacaactaacgcgtcgcctgcccgacacgtccgttcggcgactagttcggtttaccaccccgtttcacttcccttaccccgcctactctagacttagtcctaccgg

SEQ ID NO: 103844 - DNA, 609 bp, Homo sapiens
  misc_feature: GYAE6OF01B7KWZ.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttctggattcacgtttacctctatagtatcaacgtgggtgcgccaggccgctggaccaacgacctggagtggatggggatcggggaccaaaccctaacactgggtcgtcacagtgtccttcacccgatcccgtccggacacgtaccttaccagtcgacccaacgaacctccctactaataaaccacacgtccctacgatggattacggaagcgcctagaacatcgtagacgacgaccggtcctacttattaccgtggtgaccggagtacgtcccacggacgttccgggtcgaacgtcccgtaacggcaacggtccggtccgtttagaccggtttcggtcggggacccaggggaccgtcccgttacggg

SEQ ID NO: 103845 - DNA, 609 bp, Homo sapiens
  misc_feature: GYAE6OF01AMCO3.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcaggcttctggaggcaccttcagcgactatagttcaattgggtgcgacgggcctctggacaggccttgagtggagtgggagatcgtcctatcgttgacacaccaactcgcacagacgtccaggcagacctacaccagtaaccgacggaacaaacgttaacgaactaacaagttaactcgtaaggacgtactaggaacacggtcctagtacattcgtaggacggacgaccgggtcttaccttacgttctggtcgacgtaggtattaattacgtactaacctacgtacgtcctttacccgttttacctcccgtttacccttgttaccttccggtcgggtaccctacggtcccgggtaaccccccggtaccg

SEQ ID NO: 103846 - DNA, 584 bp, Homo sapiens
  misc_feature: GYAE6OF01C5HC2.17.34.D01.1.454.CMB.1.raw
  modified_base (340)..(340): a, c, t, g, unknown or other
  misc_feature (340)..(340): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcagtctggggctgaggtgaagaagcctggggcctcagtgaaggtctcctgcaaggcttctggattcacgtttacctcctatagtatcaactgggtcgcgtccaggccgctggaaccgaacgacctgagtggataggatgggacaacccgtaanacgtggtgtcaacgtagtgtcttcaccctatcccgtccgggacagacctttaccatcgacccacgaacctcctaccaactaaacacagaccctaacataggagttgacggtacgcctgactatctagacgacacggccgtctacttactgtgcgaacgacgtcccacgtacgtccggtcgaacgccgtaccggccgaaggtccggtccgttttacgacgtttccggtgggggcccgtaacgggg

SEQ ID NO: 103847 - DNA, 636 bp, Homo sapiens
  misc_feature: GYAE6OF01DIWCV.17.34.D01.1.454.CMB.1.raw
  modified_base (290)..(290): a, c, t, g, unknown or other
  misc_feature (290)..(290): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcgggtgagggtctccgtgcaaggcttcgtggaggccaccttcagcgactatagtttcaagtttgggncggacggcctcgtggacaggccttggagtggagtgggaagactcgtccctagtcgtcgaccacaaccaactacgacaacagaacgtccgaggcagactcaccgaataaccgcgaactaaacttaacgaactaacgaacgttaactacgtaggagtacgtacgaaacacgtcctacgtacactcgtaggaacggtaccgtacgggtacctttacgtaccgttcgtggtacgcgtaaggtagttaacttactataaacctcttacgttccttaccttttaccctaccctttaccgttacgtaccgttccggtacgggtacctacgttcccggaacccccggttacccg

SEQ ID NO: 103848 - DNA, 544 bp, Homo sapiens
  misc_feature: GYAE6OF01CAD6T.17.34.D01.1.454.CMB.1.raw
  modified_base (462)..(462): a, c, t, g, unknown or other
  misc_feature (462)..(462): n is a, c, g, or t
  modified_base (509)..(509): a, c, t, g, unknown or other
  misc_feature (509)..(509): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcggtgagggtctcctgcaaggcttcgtggaggcaccttcagcgactatagtttcaattgggtgcgacgggcctctggacaaggccttggagtggatgggaagatcgtcctatcgttgacacacaaactcgcacagaacgttcaggcagactcaccataaccgcggaacaaattaacgaacacgaattaatcgtggagcagaacagctgtacatcgtgaggacacgggtcttctacttctgtgngagtaagttaagttactataactctcgcttcctttacaccttccctntaccttgtcggtctagtcggaccctcgccgttccg

SEQ ID NO: 103849 - DNA, 588 bp, Homo sapiens
  misc_feature: GYAE6OF01CJTBX.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaaggccttgagtggatgggaaggatcgtccctatcgttgacacaccaaactacgcacagaagttccgaggcagactcacataaccgcggaacaaataacgaacacagttaatacgtagagactagaacgacgcctgtacatctagacggacgacgggtcttacgtacttacgtgtcgcgaggtagtaacttactactaactacgttacgtcctttaccttttacctaccccttcccgttacgtaccgtttcgtacgggtaccctacgtccgggtacccccgttcccg

SEQ ID NO: 103850 - DNA, 579 bp, Homo sapiens
  misc_feature: GYAE6OF01DC6MZ.17.34.D01.1.454.CMB.1.raw
  modified_base (285)..(285): a, c, t, g, unknown or other
  misc_feature (285)..(285): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttttcaatttgggtncgacgggcctctggacaaggccttgagtggatgggaagatcgtccctatcgttgacacacaaactacgcacagaagttccagggcagactcaaccataaccgcgaacaaattaacgaacacaagttaatctaggagactagaacagcctgtacatctagaggacgacgggtcttctacttctgtgtcgaggtagtaattactaataaacactacgtccttacctttttaccaccctttcccttacgttaccgtttccgtacgggtaccctacgttccggaaccccggttacccg

SEQ ID NO: 103851 - DNA, 568 bp, Homo sapiens
  misc_feature: GYAE6OF01D0QF7.17.34.D01.1.454.CMB.1.raw
  modified_base (327)..(327): a, c, t, g, unknown or other
  misc_feature (327)..(327): n is a, c, g, or t
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggaggcaccttcagcgactatagtttcaagtttgggtgcgacgggcctctggacaaggccttgagtggatgggaaggntcgtcctatcgttgacacaccaaactacgcaacagaagtccagggcagactcaccataaccgngaacaataacgaacacagttaatcgtaggagactagaacngcctgtcatctgaggacgacgggtcttctacgttctgtgcggaagagttaattactataactactcgtcctttaccttttactacccttcccgttagtaccttcgtcgggaccctacgtccggtaaccccggtacccg

SEQ ID NO: 103852 - DNA, 609 bp, Homo sapiens
  misc_feature: GYAE6OF01BWIPN.17.34.D01.1.454.CMB.1.raw
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggattcacgtttacctcctatagtatcaactgggtncgccaggccgctggacaacgcctgagtggatgggatgggcaaaccctaanacgtggngtcacagtcgtaccttcacccatcccgtccgggacacggtaacttaccatcgacccaacgaacctcctacaataaacacagcctanatgagtgacgganccgtgacatctgaacgccaacgggtcccttacgtaactttacgtgtacggtcgaacgtacggtacccaaccggtacgtcccgggtagacgtcccgtacgggcaacgggtcccggtacctttcggaccgtttccggtacgggggacccaaggggtaccgtccccggttacggg

SEQ ID NO: 103853 - DNA, 821 bp, Homo sapiens
  misc_feature: GYAE6OF01EYPAG.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcgagcagctacgaggtcgtccacgtcccgaggtcctaggttggtgacaatcgtggggctgaggtagaagacgccgtgggtcctcggtggacgggtcctcgtgacgacggtcttcgtgggacgcctacctcgacgacgtacttagtttacgttactaaggtttgggtcggaccgggaccgggtccttaggtacggaacgaacggttccgttaggtagggtaggtaggtaggggaacggtcgttcccgttacctagtttcggtacgaacctaaccaaaccgtaacgtacgacaacgaagttaccgtacggacggacaacgtactaccaactaaacgaccggacgaaacttaaacgtaaccgaactaacgttaagttaactcggtaggacgtacgtaacgaaccgtacgtcttacgtactactcggtaagggaacggaccggtacggttccttaccgtttacccgttggttacggtacggaacggtaagggttaaacgtttaaactttaacgttaaacgttaaaccgtacgtttacccgtttaacccgttttttaaccccttttaaccccttacccccgttttacccggtttaacgtttaccccgtttccggggggttacccggtaaccctttaccggggttaaaccccccgggttaacccccggttaaccccgg

SEQ ID NO: 103854 - DNA, 642 bp, Homo sapiens
  misc_feature: GYAE6OF01BBLGL.17.34.D01.1.454.CMB.1.raw
  modified_base (328)..(328): a, c, t, g, unknown or other
  misc_feature (328)..(328): n is a, c, g, or t
  modified_base (387)..(387): a, c, t, g, unknown or other
  misc_feature (387)..(387): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctcctgcaaggcttcgtgggaggcctaccttcagcgactatagtttacaagttgggtgcgacggggcctctggacaaggccttgagtggatgggaagntcgtcctatcgtgacacaccaaactcgcacagacgtcaggcagactcaaccataaccgngaacaaattaacgaacacagtaatcgaggagactagaacagtcctagtcatctaggaagacgtacgggtcctttacgttacgttcgtaggtcgtaccggaggtaacgttaaacttacgtaactaacctacgttaccgttacctttacccgtttttaaccacccctttcccttacggtacccgtttcgggtacgggggtacccctaacggttaccccggggtaaaccccccggttccctaaacccgggtttccccc

SEQ ID NO: 103855 - DNA, 551 bp, Homo sapiens
  misc_feature: GYAE6OF01EBL3T.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaaggccttgagtggatgggaagntcgtcctatcgtgacacaccaactacgcacagagttccagggcagactcaccataaccgacgaacaaataacgaacacagttaatctagagactagaacagtcctagtcatcgtagacgacgacggtcttactactgtgtagcgagtataatactatacatcgtcctttacctttacctccttcccttagtaccttcggtcggtacctacgtccggaccccgtaccg

SEQ ID NO: 103856 - DNA, 585 bp, Homo sapiens
  misc_feature: GYAE6OF01B28MP.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggccaccttcagcgactatagtttcaattgggtgcgacgggcctctggacaaggccttgagtggatgggaaggatcgtccctatcgttgacacaccaaactacgcacagaagttccgaggcagactcaccataaccgcgaacaaattaaccgaacaacagttaatctaggacgctagaacagcctgtcatcgtagacggacgacgggctttactacttctcgtagacgaggtaacgttaattactaataactactagtacctttaccttttacctacccttcccttcgtacctttcgtcggggtcctacgtaccggtaccccggtcgtcccgtcccg

SEQ ID NO: 103857 - DNA, 557 bp, Homo sapiens
  misc_feature: GYAE6OF01DOB2F.17.34.D01.1.454.CMB.1.raw
  modified_base (286)..(286): a, c, t, g, unknown or other
  misc_feature (286)..(286): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttcgtggaggcaccttcagcgactatagtttcaagtttgggngcgacggcctctggacaaggccttgagtggatgggaagatcgtcctatcgttgacacacaaactacgcacagaagttccgaggcagactcaaccagtaaccgcggaacaaattaacgaacaactagtaatctaggagctagaacagcctagtcatctagagacacgggtcttctacttcgtgtgacgtagtagtaatactatactactcgtccttactttactcccttccttacgtaccttcgtcgggacacgttccggacccggttcccg

SEQ ID NO: 103858 - DNA, 610 bp, Homo sapiens
  misc_feature: GYAE6OF01BMOWZ.17.34.D01.1.454.CMB.1.raw
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (399)..(399): a, c, t, g, unknown or other
  misc_feature (399)..(399): n is a, c, g, or t
  modified_base (550)..(550): a, c, t, g, unknown or other
  misc_feature (550)..(550): n is a, c, g, or t
tcagcgtagactagcacgaccggtgctcgatttagatcgtctgtgttggggtttggggatcacaaaacaaccagattcctcctctaaagaacgcccctgggagcacagctcatcaccatggactggacctggaggttctctttgtggtggcagcagctacaggtgtccagtcccaggtccagttggtgcatctggggctggaggtgaagacgcctgggtcctcgggtgagggtctccgtgcaaggtcttcgtggaggccaccttcgagtccgtacttatacgtttcaagttgggtgcggacggcctgtcggacaggtccttggacgtggagtgggaagntcgtccgtatcgtgacacaccaatcacanagacgtcagggcagactacgacactaaccgngaacaactaacgaacactaagttaactactggaagtcgtagaacgacgtacctagtacagtcgtagacggacgacggtcttacgtacgtttcgtgttcggacgtaggacgttaagttactaatacgtaactgtacccgtttactttacccncccgttacccgttacgtaccgtttcgtacgggtacctcggtaccggtacccccggttacg

SEQ ID NO: 103859 - DNA, 557 bp, Homo sapiens
  misc_feature: GYAE6OF01D1PQI.17.34.D01.1.454.CMB.1.raw
  modified_base (550)..(550): a, c, t, g, unknown or other
  misc_feature (550)..(550): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttctggaggcaccttcagcgactatagtttcaattgggtgcgacgggcctctggacaaggccttgagtggatgggaaggatcgtccctatcgttgacacaccaaactacgcacagaattccagggcagactcacataaccgcggaacaaattaacgaacacaagttaactactaggagctagaacagcctgtcatctgaggacacgggtcttctacttcgtgtgcgtaggagttaagtactataacactagtccttccttttacacccttcccttgtaccttcgtacgggtccagtcggaaccccgtcncccgtcc

SEQ ID NO: 103860 - DNA, 545 bp, Homo sapiens
  misc_feature: GYAE6OF01ASCLH.17.34.D01.1.454.CMB.1.raw
  modified_base (430)..(430): a, c, t, g, unknown or other
  misc_feature (430)..(430): n is a, c, g, or t
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaggatcgtcctatcgttgacacaccaaactacgcaacagaagttccagggcagacctacaccataaccgcggaacaagttaacgaacaacagttaatctaggagctagaacngcctgtcatctagaggacacggtcttctacttcgtgtgcgagtagtaattactatacnctgtcttacctttacncccttccttcgtacttcgtcggacacgtccggacccgtccg

SEQ ID NO: 103861 - DNA, 670 bp, Homo sapiens
  misc_feature: GYAE6OF01CH4A8.17.34.D01.1.454.CMB.1.raw
  modified_base (259)..(259): a, c, t, g, unknown or other
  misc_feature (259)..(259): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaagttgggtgcgacgggcctcgtggacaaggccttggagtggagtgggaaggatccgtcctagtcgttgacacgaccaaactcgacacagaacgttccgagggcagactacaaccagtaaccgcgaactaaacttaacgaacaactaagttaactcgtaggagctagaacacgtcctagtactatcgtagacgtaaccgacgggtacctttacttaccgttacgttcgtacggtacggaacgggtaacgtttaaacgtttacgttaaacttaaaccgtacgttaccggttaccctttaacccgttttttaaccctacccctttaccccgtttacgttaccgtttccggtaccggggtaccctaacggttaccccgggtaacccccggttaccccgg

SEQ ID NO: 103862 - DNA, 604 bp, Homo sapiens
  misc_feature: GYAE6OF01C1C21.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaagatcgtcctatcgttgacacaaccaaactcgacacagaacgttccaggcagactcaaccataaccgcggaactaaattaaccgaacaactaacgttaatacgtaggacgactagaacacgcctagtacatctagaggaccgacggtcttacgtacttcgtgtgcgaggtagttaacttactaataactacgtcgtccttacccttttacctaccctttcccgttcgtacctttccggtcgggtaccctacgttaccgggtaacccccggttccgtacccggttccc

SEQ ID NO: 103863 - DNA, 583 bp, Homo sapiens
  misc_feature: GYAE6OF01EC6XZ.17.34.D01.1.454.CMB.1.raw
  modified_base (329)..(329): a, c, t, g, unknown or other
  misc_feature (329)..(329): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (529)..(529): a, c, t, g, unknown or other
  misc_feature (529)..(529): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggccaccttcagcgactatagtttcaattgggtgcgacgggcctcgtggacaaggccttggaggtggagtgggaagtntcgtcctagtcgtgacacaccaaactacgcacagaacgttcgaggcagactacaccataaccgacgaacaaattaacgaacacaagttaacncgtaggagactagaacagcctgtcatcngacggacacggtctttactacttcgtggtcgacgaaggtattaattactaataacctacttacgtcctttacctttaccncccttcccttagtaccttcgtacgggtacctacggttcccggaccccggtaccg

SEQ ID NO: 103864 - DNA, 724 bp, Homo sapiens
  misc_feature: GYAE6OF01AD1R9.17.34.D01.1.454.CMB.1.raw
  modified_base (247)..(247): a, c, t, g, unknown or other
  misc_feature (247)..(247): n is a, c, g, or t
  modified_base (466)..(466): a, c, t, g, unknown or other
  misc_feature (466)..(466): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctgggtgagggtctcctgcaggtcttcgnggacgctaccttcagcgactatagttcaagttgggtgcggacggcctgtggacgaggtccgttaggaggtggagtgggaaggtactccgtacctatccggttgaaccaacctaccaactacgacacgtagacgtcgaggtcacgtaccacaaccgactaacccggacgaaactaaacttaaccgaactagtacgttaatcgtaggacgtactacgaacncgtaccgtacgtactagttaccggtacggacggtaaccggtccggttaccttaccgttacgtttcggacggttacgggtaacggtaaggttaaacgtttaacttaccgttaaacgtaacccgttacgttaccgtttacccttttaacccgttttacccttaccccgtttccggttaccgttacccgtttaccggtacccgggttaaccccgtaccgggttaccccgggtaaccccggttcccgtcccgttacccccgg

SEQ ID NO: 103865 - DNA, 580 bp, Homo sapiens
  misc_feature: GYAE6OF01BLBCJ.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaggccttgagtggagtgggaaggntcgtccctatcgttgacacaccaaactacgcacagaacgttccgaggcagactcacataaccgcgaacaaataacgaacactagtaactactaggagactagaacacgcctagtacatctgagacgacggtcttactacttcgtgtcgacgaggtacgttaacttactaataactacgtcgtcctttacccttttacctacccttacccttcgtaccttcgttcgggacctacgtaccgggtaccccggtacccg

SEQ ID NO: 103866 - DNA, 711 bp, Homo sapiens
  misc_feature: GYAE6OF01EJ4HS.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgccgtgggtcctcgggtgagggtctccgtgcaaggtcttcgtggaggcctaccttcgagcgtactagttagtttactaagttgggtgtcggacgggtccctcgtaggacgaaggtccttggaggtggagtggggaagtacgtcgtcctagtcgtagacacaaccaactacgacacgaagtacgtccgaggcaagactacaccaacgtaccggacggtaaactaaaacgttaaccgaaactaacgtaagttaactacgtaggaacgtactaagaaccacgtccgtagtactatcgtaggacggacgtaccgggtcttacgtaacttcgtcggtacggtacgtaggttaagttaacgttaaccttaataaaccgtacgttaccgttacccttttacccgtttttaaccctaccccttttcccgttacgttacccgtttaccggtaccggggtacccttaacggttaccccgggtaaccccccggttccgtaccccggttaccccg

SEQ ID NO: 103867 - DNA, 549 bp, Homo sapiens
  misc_feature: GYAE6OF01A9AW6.17.34.D01.1.454.CMB.1.raw
  modified_base (321)..(321): a, c, t, g, unknown or other
  misc_feature (321)..(321): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (504)..(504): a, c, t, g, unknown or other
  misc_feature (504)..(504): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaggccttgagtggatgggagntcgtcctatcgttgacacaccaactacgcacagacgttccagggcagactcaccataaccgcgaacaataacgaacacagttaatctggancgtagaacagcctgtacatcngaggaccacgggtcttacgtacttcgtgtgacgaggtagtaattactataactactcgtcttccttttacncccttccttcgtacttcgtcgggacctacgtcggaccccggtccg

SEQ ID NO: 103868 - DNA, 776 bp, Homo sapiens
  misc_feature: GYAE6OF01C8O03.17.34.D01.1.454.CMB.1.raw
  modified_base (102)..(102): a, c, t, g, unknown or other
  misc_feature (102)..(102): n is a, c, g, or t
  modified_base (253)..(253): a, c, t, g, unknown or other
  misc_feature (253)..(253): n is a, c, g, or t
tcagcgtagactagcacgaccggtgctcgatttagatcgtctgtggttgggtttggggatcacaaaacaaccagattcctcctctaaagaagcccctgggancacagctcatcaccatggactggacctggaggttcctctttgtggtggcagcagctacaggtgtccagtcccaggtccagttggtgcaatcgtggggctggaggtgaagcgccgtgggtcctgggtgagggtctccgtgcgaaggcttcgngggaggctaccttcgagcgtaactagttagtttacaagttggggtcgcggacgggtccttcgtagggaacctaagggtccttaggaggttgggaagtggggaagtacttccggtccttagttcggttacaaccaacaaaccctaaacgtaccgacaacgtaaggtaaacgttccgaacgggcaacgactaccaaccgtaacgtaacccggaacgaaactaaaacgttaaccgaaacctaacgtaagttaactacgtagggtaactacgtaacgaaacgacgtctacgtactacgtacgtacggaacggaccgtacgggttcctttaccgtactttcggtacggtacgacggtaaaggttaacgtttaaacttaacttaacgtaaaaccgttcttaccggttacccttttttaaccccttttaacccgtaccccgttttaccgttacggttaaccccttttccggggtaaccggggttaccccttaaccggggtttaacccggtaaccccccgggtttaacccc

SEQ ID NO: 103869 - DNA, 564 bp, Homo sapiens
  misc_feature: GYAE6OF01A034Q.17.34.D01.1.454.CMB.1.raw
  modified_base (485)..(485): a, c, t, g, unknown or other
  misc_feature (485)..(485): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgttgacacaccaaactcgcacagaagttccagggcagactcaccataaccgcgaacaaattaacgaacacagttaatctaggagactagaacagcctgtcatctgaggacacgggcttctacttctgtgcgtaggtagtaattactaataacactntccttaccttttaccacccttcccttcgtaccttcgtacgggtccctacgtaccggaaccccggttctacccggttccc

SEQ ID NO: 103870 - DNA, 550 bp, Homo sapiens
  misc_feature: GYAE6OF01CVH7V.17.34.D01.1.454.CMB.1.raw
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagtttgggtgcgacgggcctgtggacaaggccttggagttggatggggaagatcgtccctatcgttgacacaccaaactcgacanagagttccaggcagactcacataccgngaactaataacgaacacataactcaganctagaacngctgcatctgagacgacggcttctacttcgtagtcgacgtagtagtaattactaataacactcgacctttcctttacacccttccttagtacttccgtacgggtctaacgtcggtaaccccgtccg

SEQ ID NO: 103871 - DNA, 580 bp, Homo sapiens
  misc_feature: GYAE6OF01CVFTD.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggagtgggaagatcgtccctagtcgttgactacaccaaactacgcacagaacgtcagggcagactacaccataaccgacggaacaaataacgaacacaagttaatctaggagctagaacacgtacctgtacatcaggacggacgacgggtccttctacttctggtacggaccgtaggagttaattactaataacctacgtgtaccttccttttacacccttccttcgtacttcgacgggtcctagtaccggtaccccgtcgtcccgttcccg

SEQ ID NO: 103872 - DNA, 574 bp, Homo sapiens
  misc_feature: GYAE6OF01BQ4KK.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttcgtggaggcaccttcagcgactatagtttcaattgggtgcgacgggcctctggacaaggccttgagtggatgggaagatcgtcctatcgtgacacaccaactcgcacagaacgtccaggcagactcacataccgcgaacaaattaacgaacacaagttaactcgtaggacgctagaacagacctgtacatcgtgacggacgacgggtcttcgtacttcgtgtcgacgtagtacgtaattactaactaactactgtaccctttacgttttacctacccttccttcgtaccttcgtacgggacctacgtaccggaaccccgtcgacccgtccc

SEQ ID NO: 103873 - DNA, 557 bp, Homo sapiens
  misc_feature: GYAE6OF01CS331.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaagggcctttgagtggatgggaggatcgtccctatcgtgacacacaactacgcacagaagttccaggcagactcaccataaccgcggaacaaataacgaacacaagttaatctaggagctagaacagtcctgtcatctagaggacgacggtcttctacttctgtgcgaggagtaattactataacacttgtccttaccttttacacccttcccttgtacctttcgtacgggtacctacgtcggtaccccggtacccg

SEQ ID NO: 103874 - DNA, 566 bp, Homo sapiens
  misc_feature: GYAE6OF01EWKQG.17.34.D01.1.454.CMB.1.raw
  modified_base (247)..(247): a, c, t, g, unknown or other
  misc_feature (247)..(247): n is a, c, g, or t
  modified_base (434)..(434): a, c, t, g, unknown or other
  misc_feature (434)..(434): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaagttgggtgccgacgggtcctcgtgggacaaggccttggaggtggatgggaagatcgtccctagtcgttagacacaccaaactacgcaacagaagtccaggcagactcacataaccgcgaacaataacgaacacagtatctagagctagaacagtcctntcatctgacgacgacggtcttactacgttcgtgtacgcgtaaggtagtaattactaactaacacttacgtccttacctttacacccttccgttgtaccttcgtcgggtacctacgtccggaccccgtacccg

SEQ ID NO: 103875 - DNA, 621 bp, Homo sapiens
  misc_feature: GYAE6OF01DEWE6.17.34.D01.1.454.CMB.1.raw
  modified_base (419)..(419): a, c, t, g, unknown or other
  misc_feature (419)..(419): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaagggccttggagtggagtggggaagtatccgtccctatcgttgaccacaccaaactcgcacagaacgttccagggcagactcaaccataaccgcgaacaataacgaacacaagttaancgtaggagactagaaccacgcctgtacatcgtaggacggacgacgggtaccttcttaaccttcgtgtgacgaggtagttaacttaactaagtaaacctacgttacgtccctttacccttttttaacctaccccttccccgttttacgtaccctttcccgttacggggtaccctaacggtccgggtaaccccccggttacccg

SEQ ID NO: 103876 - DNA, 581 bp, Homo sapiens
  misc_feature: GYAE6OF01ADG2G.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttggagtggatgggaagntcgtccctatcgtgacacaccaactacgcacagaacgtcaggcagactcacataccgcgaacaaattaacgaactactagtaatcgtaggagtactagaacacgacctgtacatcaggacgacgacggtcttactacttcgtgtcgtacggaggtagttaacttactaataacacttacgtacctttaccgttttacacccttccttcgtaccgttcgtcggtaccctagtacccggtaccccgtcgtcccgttcccg

SEQ ID NO: 103877 - DNA, 617 bp, Homo sapiens
  misc_feature: GYAE6OF01CLVOE.17.34.D01.1.454.CMB.1.raw
  modified_base (327)..(327): a, c, t, g, unknown or other
  misc_feature (327)..(327): n is a, c, g, or t
  modified_base (548)..(548): a, c, t, g, unknown or other
  misc_feature (548)..(548): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtctccgtgcaaggcttctggaggctaccttcagcgactatagtttcaagttgggtgcgacgggcctcgtggactaaggccttgagtggatgggaagtntcgtcctatcgttgacacacaaacctacgacacaacgagttccgaggcaagactcaccagtaaccgacggaactaaataacgaacacgaagtaactcgtagagctagaacacgcctagtacatcgtagaggaacacgggtctttacgtacttcgtgtacgacggtacggtagtaattacgtaataaccgtacttacggttacctttacccgttttaacccnccctttacccgttagttaacccgttccggtacgggtaccctaacggtccgggtaacccccggttacccg

SEQ ID NO: 103878 - DNA, 543 bp, Homo sapiens
  misc_feature: GYAE6OF01BCGYQ.17.34.D01.1.454.CMB.1.raw
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatgggaagatcgtccctatcgttgacacaccaaactacgcacagaagttccagggcagactcaccataaccgcgaacaataacgaacacagttaanctgagcagaacagcctgcatcngaggacacggcttctacttctgtgcgagataagttactataacactcgtccttactttacctacccttccttcgtaccttcgtcgggtacctacgtccggtacccgtaccg

SEQ ID NO: 103879 - DNA, 563 bp, Homo sapiens
  misc_feature: GYAE6OF01BZAOL.17.34.D01.1.454.CMB.1.raw
  modified_base (284)..(284): a, c, t, g, unknown or other
  misc_feature (284)..(284): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtncggacgggcctcgtggacaaggccttggagtggatgggaagatcgtccctagtcgttgacacaccaaactcgcacagaacgttccagggcagactcaccataaccgcgaacaaattaacgaacacaagttaatcgtaggagctagaacacgcctgtcatctaggacggacgacgggtcttctacttcgtcgtgcgtaggagtaattactataacacttcgtctttaccttttacctcctcccttgtacttcgtacgggccacgtccggaccccggtccg

SEQ ID NO: 103880 - DNA, 868 bp, Homo sapiens
  misc_feature: GYAE6OF01DFNLL.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtgcagcagctacaggtgtccagtcccaggtccagttggtgcaatcgtgggctgaggtgagacgccgtgggtcctcggttaggtctcgtgcaggcttcgtggaggcctacgttcagcgacttagtacgtttcaagttgggtagccggacgggtcctcgtaggaacgaacggtccgtttaggaggttacgggagttacggggaaaggtacgttccggtacccctttagtaccggtttacgaacctaaccgaaaccccgtaaaacgtcggaacccaacgtaaacgggtaaaccgttacccgaagggtaccgaacggtacctacccgaaccgtaaacgtaaacccggtaccgggtaaaacctaaaacgttaaaacccgaaacgtaaccgttaaacggtttaacgttaccggtaagggtaacgtacgtaacggaaacctacggtacccgttacggtacctaagttaccgtagggaaccgggtaaccgttaccgggtacctttacccgtttaacgtttcgttacgggtacgtacgggtaaacggttaagtttaaacgtttaaccgtaaacgttaaccgtaccgttaccgttaacccgtttttaccccgtttttaaacccctcccgtttaccccggtttacggttaacccgttttccgggtaacccggggttaacccgttaccggtttaacccccggggttaacccccggttcccgtttaaacccccggg

SEQ ID NO: 103881 - DNA, 626 bp, Homo sapiens
  misc_feature: GYAE6OF01BUOKO.17.34.D01.1.454.CMB.1.raw
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggaggcaccttcagcgacttatagtttcaagtttgggngcgacgggtcctcgtggacaaggccttggagtggagtgggaagntcgtcctatcgttgacacaaccaactacgcacagacgttccgaggcagactaccaccacgtaaccggcgaactaaacgttaaccgaactaacgtaagttaactacgtaggacgacgtacgaacgacgtacctgtactacgtcgtagacgaccgacggtcttacgtacttctgtcgacgtaggtattaacgttactaagtaacctacgttcgtacctttacccttttacctacccgtttcccttacgttaccttcggtacggtaccgtacggttacccggtacccccggttacccg

SEQ ID NO: 103882 - DNA, 539 bp, Homo sapiens
  misc_feature: GYAE6OF01A5OEE.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaagttccagggcagactcacataaccgcgaacaaataacgaacacagtaatctaggagctagaacagcctgtcatctgagacacgggtcttactactcgtgtgcgaggagtaatactataacactgtcttccttttacacccttcccttgtacttcgtcgggtccagtcggaaccccggtccg

SEQ ID NO: 103883 - DNA, 729 bp, Homo sapiens
  misc_feature: GYAE6OF01A5JNX.17.34.D01.1.454.CMB.1.raw
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
tcagcgtagactagcacgaccggtgctcgatttagatcgtctgtgttgggtttggggtacgaaaacaaccagattcctcctctaaagaagccctgggagcacagctcatcaccatggactggacctggaggttcctctttgtggtggcagcagctacaggtgtccagtcccaggtccagttggtgcaatctggggctggaggtgaagacgcctgggtcctgggtgagggtctcctgcaaggcttctgggagcaccttnagcgactatagtttnaacttgggtgcgacgggctcgtggacaggccttgagtgngtgggaagntcgtcctatcgttnacgacaaccaactacgcaacgacgtaagttccgaacggcaacggacctcaaccgaagtaaacccgcggaaactaaacgttaaaccgaactaactaacggttaaataccgtaggtaacgacttagaaacgtacgtacctggtacacttacgtcggaaggtacccgtagggtacctttaccgtaaccgtttcgttcggtacggtaccggttaagggaacgtttaaactttaaccttaaaggtaaacccttaacgttcgtaacccggtttttaccctttttaaccgttaacccccttcccgttttaacgttacccggtttacgttaccgggggtacccttaacccgggttaacccggttaaaccccccgggttcccgtaaaccccggttttcccccg

SEQ ID NO: 103884 - DNA, 662 bp, Homo sapiens
  misc_feature: GYAE6OF01C1AT2.17.34.D01.1.454.CMB.1.raw
  modified_base (283)..(283): a, c, t, g, unknown or other
  misc_feature (283)..(283): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggacggcaccttcagcgacttatagtttcaagttgggngcggacgggtcctcgtaggacaaggccttggagtggatagggagactcgtcctatcgtgacacaccaactcgacacagaacgtccgagggcagacctcaaccactaaccggcgaaactaaattaacgaacaactaagttaactcgtaggacgactacgaacacgcctagactacgtcgtaggacggacgacgggtccttacgttacttacgtggtcgtacggtaaggttaacgttaactttactaaacttaacctaccgtacgttaccctttacccgtttttaaccctaccctttacccgtttacgtacccgtttaccggtaccggggttaccctaacggttaccccgggtaacccccggtccgttaccccgttccccg

SEQ ID NO: 103885 - DNA, 743 bp, Homo sapiens
  misc_feature: GYAE6OF01EWUEM.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggcttcgtggaggcaccttcagcgactatagttcaagttgggtgcgacgggctcgtggacaaggtccttgagtggagtgggagtatcgtcctatcgtgacacaccaactacgcaacagaacgtcgaggcacgacctacaacctaacgtaacccgacgaaactaaaacgttaacgaaactaacgtaacgtttaaactacgtaggaacgtacgtaacgaaacgtacgtacccgtagtactacgttaccgtacgggtaacggtaacccgtaaccggggttacctttaccgtttaaccgtttaccgttacggttacgggtaaccggtaaggttaaacgtttaaacttaaccgttaacttaaaccgtaccgtttacggttacccttttaacccgtttttaacccctacccgtttaccccgtttacgttaacccgtttaccgggttaccgggtaacccttaccggttaaccccgggtaacccccggttccgtaacccccggtttaccccg

SEQ ID NO: 103886 - DNA, 565 bp, Homo sapiens
  misc_feature: GYAE6OF01EM1SY.17.34.D01.1.454.CMB.1.raw
tcagcgtagactagcacgaccggtgctcgatttagatcgtctgtgttgggtttggggatcacaaaacaaccagattcctcctctaaagaagcccctggggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatggggaaggatcgtcctatcgttgacacaccaaactcgcacagaagtccagggcagactcaccataaccgcggaacaaattaacgaacactaagttaatcgtaggagctagaacagcctgtcatctagacgacgacggtcttctacttctgtgcgaggagttaattactaatacacttcgtcctttaccttttaccacccttcccttgtaccgttcgtcgggaccctagtcccggaccccggttacccg

SEQ ID NO: 103887 - DNA, 638 bp, Homo sapiens
  misc_feature: GYAE6OF01EDVNY.17.34.D01.1.454.CMB.1.raw
  modified_base (441)..(441): a, c, t, g, unknown or other
  misc_feature (441)..(441): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacgggcctcgtgggacaaggtccttggaggtggataggggaagatccggtccctaagtcggttacgaacacaccaaactacgcaacagaacgttccaggcagactcaccaataaccgacgaacaaataacgaacacaacgttaatcgtagganacgtacgaaacgacgtcctagtctatctagaaggaccgacgggtctttaccttacttcgttggtagtacgaagggtacttaaagttaacctaataacctaacgttcgtacccgttttaccttttaaccctaccccgtttcccgttacgtacccgtttcggacgggtaccctacgttccgggaacccccggttacccg

SEQ ID NO: 103888 - DNA, 630 bp, Homo sapiens
  misc_feature: GYAE6OF01BIM9H.17.34.D01.1.454.CMB.1.raw
  modified_base (320)..(320): a, c, t, g, unknown or other
  misc_feature (320)..(320): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggtcctcggtgagggtctcctgcaaggcttctggaggcaccttcagcgactatagtttcaagttgggtgcgacgggcctctggacaggccttgagtggatgggagntcgtcctatcgtgacacaccaactacgcacagacgtcagggcagactcacataaccgngaactaataacacacagttaacnctagacgtctagacngacctgtacacgtcgagagacgacgggtacttacttaccgttcgtaggtacgacgtaacgggtaagttaacgttaacgtaacttaaacgtaaccgtttcgtaacccttttaccccgtttttaacctacccccgtttaccctttaccggttaccgtttaccggttaccggggtacccctaacggttacccccgggtaaccccggttaacccccgg

SEQ ID NO: 103889 - DNA, 554 bp, Homo sapiens
  misc_feature: GYAE6OF01DED4A.17.34.D01.1.454.CMB.1.raw
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaattgggtgcgacgggcctctggacaaggccttggaggtggatggggagatcgtccctatcgttgacacaccaaactcgcacagaagttccagggcagactcaccataaccgcggaacaaattaaccgaacacaagttaatactaggacgactagaacagtcctgtacatctgacggacacgggtcttctactctgtgcgaggtagtaattaactatacactgacttccttttacnccttcccttntacgttcgtacggtccacgtcggaccccgtacccg

SEQ ID NO: 103890 - DNA, 575 bp, Homo sapiens
  misc_feature: GYAE6OF01A12YU.17.34.D01.1.454.CMB.1.raw
  modified_base (431)..(431): a, c, t, g, unknown or other
  misc_feature (431)..(431): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggagtgggaaggatcgtccctagtcgtgacacaaccaaactacgcacagaacgttccagggcagactcaccaactaaccgcggaacaaacttaacgaacactaagtaactcgtaggancagaacacgcctgtcatctgacgacgacgggtcttctacttctgtagcgtaggagtaacttactataactacgtacgtccttaccttttacctcccttccttcgtacttccgtacgggtcctacgtccggtaccccggtacccg

SEQ ID NO: 103891 - DNA, 622 bp, Homo sapiens
  misc_feature: GYAE6OF01DNWTE.17.34.D01.1.454.CMB.1.raw
  modified_base (388)..(388): a, c, t, g, unknown or other
  misc_feature (388)..(388): n is a, c, g, or t
  modified_base (424)..(424): a, c, t, g, unknown or other
  misc_feature (424)..(424): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagccctacccgcttaaaccgggacaaccgtcgcccggccaacatacgccttcctcccgtccccccttcgcagtaacaccaagtacagaatattaacctgttccatcgactacgcctttcgcctcgccgttagggtcactccaccctcgccccgtattaacgtggacacggaacccttggtcttccggcgagcgggtctttcacccgtntttactcgttacttatgtcagctattcgctacttcngtactacctcagcatcgcctacacacgccacctacttcacgacgtcttaacgacgaacctccctaccccctaaccaacaacgactaacgtaacgcgtcgctcgcccgctacgtccgttcggtcgccgtagttcggtttaccgtccccgtttacaccttcccgttcccgacctacttacctagtaccttcgtctaccgg

SEQ ID NO: 103892 - DNA, 960 bp, Homo sapiens
  misc_feature: GYAE6OF01CSD4N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggctaccttcagcgacttagtagtttacaagtttgggtgcggacggggtcctacgtgggaaccaacgggtcccttaggacggtgggaagttacgggggaaacgggtacgttccggttacccccgttaagtttaccggtttacgaaacccgtaacccgtaaccctaaaaaaccggtttacccgaacccgaaaaccgtaaacgggtaaaaccggttttacccggaaacgggggtacctaacggtaaacccgtttaaccccgaaacccgtaaaccgttaaaacccccggaaccggggtaaacctaaaaacgtttaaaacccggaaaacccgtaaaccgttaaacggtttaaaacttacccggttaacgggtaacggtaaccgtaacggaaacccgtaaccggtacccgttacgggttaccctaacgtttaccgtacgggaaccgggtaacccggtaaccggggttccctttaccgtttaaccgtttaccggtttacgggttaacggtacccgggtaaagggttaacggtttaaaaccgtttaaccgttaaacgttaaaacccgtaaccgtttacggttacccgtttttaacccctttttttaacccgtaaccccgttttacccccgtttaccggttacccgttttacccggttaccgggggttacccgttaaccgggttaaccccgggtaaccccccggtttaaacccccgg

SEQ ID NO: 103893 - DNA, 592 bp, Homo sapiens
  misc_feature: GYAE6OF01A4AWE.17.34.D01.1.454.CMB.1.raw
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaagttgggtgcgacgggcctctggacaaggccttgagtggagtgggaagntcgtcctatcgttnacacaccaactacgcacagaacgttccaggcagactcaccataacccggcggaacaaataacgaacacagttaatctaggaagctagaacagtcctgtcatctgacgacacgggtcttctaccttcgtgtgcgaggtacgttaacttactaataaactacttgtcctttacccttttaacctcccctttccccttacgtaccctttccgttacggggtaccctaacggttcccgggtaacccccggttcccg

SEQ ID NO: 103894 - DNA, 532 bp, Homo sapiens
  misc_feature: GYAE6OF01AT25J.17.34.D01.1.454.CMB.1.raw
  modified_base (269)..(269): a, c, t, g, unknown or other
  misc_feature (269)..(269): n is a, c, g, or t
  modified_base (497)..(497): a, c, t, g, unknown or other
  misc_feature (497)..(497): n is a, c, g, or t
  modified_base (524)..(524): a, c, t, g, unknown or other
  misc_feature (524)..(524): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagcatccttttcctggtggcagcaggcacaggtgcccacgcccaggttcagttggtgcagacgtggggctggaggtgcagaagcctggggcatcagtgactgtctcctgcaaggccagtggatatatcttcacaaaatntggtatgaattgggtgcgacacggcccccggagaagggcttggaggtggggtggggtgggtcaggtggcgtttggacggtaaggcacgagtatgcacggaagagtaggaagggcagagtcacgactaccgacggaccaccccagaacacagtctacatgacaactgacgagcctagagagactcggacgacgacggtccgtactatactgtgcgaagtagttgtttcngtcatacgttaactatttgaatacgtnttcgtagg

SEQ ID NO: 103895 - DNA, 621 bp, Homo sapiens
  misc_feature: GYAE6OF01CTSM9.17.34.D01.1.454.CMB.1.raw
  modified_base (261)..(261): a, c, t, g, unknown or other
  misc_feature (261)..(261): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcgggtgagggtctcctgcaaggcttctggaggcaccttnagcgactatagtttcaagttgggtgcgacgggcctcgtggacaaggccttgagtggatgggaagtatcgtcctagtcgttgactaacgacaaacctacgcaacagaacttcgaggcagactcacataccgcgaactaataacacactagttaatctaggacgctagaacacgtctagtcactcgtcgaacgtacgacgggtcttacgttacgttacgtgtcggacgaagggtactaaacgtttaacctaaagttaacctacgttccgttacctttaccctttttaactccccctttacccttgtttacccgttccggttacgggtacccttacggtacccggtaaccccgggttaccccg

SEQ ID NO: 103896 - DNA, 677 bp, Homo sapiens
  misc_feature: GYAE6OF01BWE2K.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacggccgtgggtcctcgggtggagggttctccgtgcaagggtcttcgtgggacggtcaccgttcgagcgactatggtttcaagttgggtgcgacgggcctgtggacaaggccttgagtggatgggaaggtatcgtccctatcgttgacacacaaactacgcacagtacgtcaggcagactcaccagtaaaccgcgaactaaacttaacggaacaagtagtaactcgttaggaacgcgtaacgaacacgtccgtagtacctactacggttaggacggtaaccgtaccggggtccttaacgttaccttaccggtacggttacgtaacgggtacggtaagttaacttaacgttaacgtaaactccgttacgtacctttacccgtttttaaccctacccgttacccgttacgttaacccgtttccggttacccggggtacctaccggtaccgggtacccccggttaaccccg

SEQ ID NO: 103897 - DNA, 619 bp, Homo sapiens
  misc_feature: GYAE6OF01E1BSA.17.34.D01.1.454.CMB.1.raw
tcagcgtagactagcacgaccggtgctcgatttagatcgtctgtgttgggtttggggacaaaacaaccagattccctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaggcttcgtggaggcaccttcagcgactatagtttcaagttgggtgcggacggcctgtggacaaggtccttgagtggagtgggaagtctcgtcctatcgtgacacacaactacgacacgagacgtcgacggcagacctcaccaacgtaacccgacgaactaaaactaaccgaacaacgaagttaactcgtaggacgactaagaacagtacctagtacagtcgtagacggtacgtacggtcttacttacgttctggtgacgaggttaagttaacgttactaactaacgtacttacgtacctttaccgttttacctaccctttaccgttcgtaccgttacgtccggtacctacgtacccggtaacccccgtcgtcccgttcccc

SEQ ID NO: 103898 - DNA, 573 bp, Homo sapiens
  misc_feature: GYAE6OF01AB0EU.17.34.D01.1.454.CMB.1.raw
  modified_base (138)..(138): a, c, t, g, unknown or other
  misc_feature (138)..(138): n is a, c, g, or t
  modified_base (144)..(144): a, c, t, g, unknown or other
  misc_feature (144)..(144): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagcgtagactagcacgaccggtgctcgatttagatcgtctgtgttgggtttggggatcacaaaacaaccagattcctcctctaaagaagcccctgggagcacagctcatcgaccatggactggacctggagttccnctttgnggtggcagcagctacaggtgtccagtcccaggtccagttgtgcaatcgtggggcctggaggtgaagacgcctggggtccctcgggtgagggtcctcctgcaaggctttcgnggacgctaccgttnagcgactatagtttcaagttcgggtgcgacgggcctcgtggacaaggccttgacgtggatggggaagatcgtcctatcgttgacacaccaactcgcacagacgttccagggcaggactcaccataccgcgacaatacgacacagtatctgagctagacagctncatcngagacgcggtctactacgttcgtagtcgcgaaggtacgtaacttacacttaccacgttacgtcctttaccttttaccgcccttccccgttataccgtttccgtacggggccctacggttccggaaccccgttcccg

SEQ ID NO: 103899 - DNA, 697 bp, Homo sapiens
  misc_feature: GYAE6OF01CWAN5.17.34.D01.1.454.CMB.1.raw
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaagtttgggtgcggacgggcctgtaggacaaggtccttaggaggtggagtggggaaggtacgtccgtaccctagtcgttagacctaccaaccaaacctcgacaactaagaacgttaccagggcaacgactaccaaccaacgtaacccgacggaactaaacgttaaaccgaaaccaacgtaagttaaactacgtaggaacgacgtaacgaaccaacggaccttacgtacctagtaccgttaggaacgggtaccgaccgggttcctttaccgttaccgtttcgttcggtacgtacggtaagggtacgttaaacttacgtaactaaactacgttacgtacctttaccttttaacctacccctttacccgttacgttaccgttccggtacgggtacctaacggttacccgggtaaccccggtaccccg

SEQ ID NO: 103900 - DNA, 605 bp, Homo sapiens
  misc_feature: GYAE6OF01DHXQ9.17.34.D01.1.454.CMB.1.raw
  modified_base (230)..(230): a, c, t, g, unknown or other
  misc_feature (230)..(230): n is a, c, g, or t
  modified_base (391)..(391): a, c, t, g, unknown or other
  misc_feature (391)..(391): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtgcagcagctacgaggtcgtccagtcccaggtccagttggtgcaatcgtggggctgaggtgaagacgccgtgggtcctcgggtgngggtctcctgcaaggtcttcgtggacgctaccttgagcgactatagtttcaagttgggtgcggacggtcctgtggacaaggtcttggaggtggagtgggaagtctcgtcctagtcgtcgaacaccaacaactacgcaactagactcgagcagactcacaanacgagaactaaactaacaacataagttaacncgtagganactagaacacgctagtacatacgtagacgacgtcggtactcttacgttcgtgtcgacgtaaggtataacgttaactaacgtactacttacgttacctttaccgtttaacctcccttaccgttcgtacccgtttcggtaaccggtccctaacggttacccggtaccccgttacccg

SEQ ID NO: 103901 - DNA, 754 bp, Homo sapiens
  misc_feature: GYAE6OF01C4339.17.34.D01.1.454.CMB.1.raw
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
tcagcgtagactagcacgaccggtgctcgatttagatcgtctgtgttgggtttggggacaaaacaaccagattcctcctctaaagaacgcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcaaggtcttcgnggagcaccttnacgcgtactatagttcaagttgggtgcggacgggcctcgtaggaacaaggtccttaggaggtaggagtaggggaaaggtactccggtccgtagtcggttagaccaaccaaccaaacgtacgaccaacgtaacgtaacgttacccggaacgggaccaacggtacctaaccgaaccgtaaacgtaaaccccggaacggtaaaactaaaaaccgttaaaccgaaaccgtaacgttaaacggttaaacgtaccgtaaggtaacgacgttaaacgaaacgtacgtaccttacgtactacgtaccggtaggaaccgggtacgtaccgggttaccttacgttacttacgtgtacgggacgtaaggtaattaaacgttactaacgtaactacgtacttcccgtttaccttttaacccaccgtttacccgttcttaccgtttcggtaccgggtaaccttaaccgggtaccccggtaaacccccgggtctaaccccggttccc

SEQ ID NO: 103902 - DNA, 532 bp, Homo sapiens
  misc_feature: GYAE6OF01CGKTU.17.34.D01.1.454.CMB.1.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (491)..(491): a, c, t, g, unknown or other
  misc_feature (491)..(491): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtncgagggcctcgtggacaaggccttgagtggatgggaagntcgtcctatcgttnacacaccaaactcgacacagaacgttcaggcagactcacataaccgngacaataacacacagtactnganctagaacagctgcatctgagacgacggtcttacgtacttcgtggtgcgaggtacgtaattactatacactgtcttactttaccnccttcctagtaccttcggcggacctacgtcggacccgtccg

SEQ ID NO: 103903 - DNA, 562 bp, Homo sapiens
  misc_feature: GYAE6OF01DRMAZ.17.34.D01.1.454.CMB.1.raw
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggctaccttcagcgactatagtttcaattgggtgcgacgggctctggacaaggccttgagtggatagggaggatcgtcctatcgttgacacaccaactacgggcacagacgtcaggcagactcacanaaccgacgacaaactaacgaacacagttaancgtaggagactagaacagcctgtaccatctggaggaccgacggtcttactacttctgtcgcgaggtagtaattactatacgtactcgtccttaccttttacncccttcccgttntaccgttcgtcggtacctacgtccggtacccggtacccg

SEQ ID NO: 103904 - DNA, 610 bp, Homo sapiens
  misc_feature: GYAE6OF01BY92W.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatttgggtgcgacgggcctctggacaaggccttggagtggatgggaagntcgtcctatcgttgacacaccaaactacgcacagaagttccagggcagactcaaccataaccgcggaacaaattaacgaacaacagttaatacgtaggagactagaacacgacctgtcatcctagaggacgacgggccttacgtaccttcgttcgtacgacgacggtagtaaagttaaccgtaataaactaaccgttacgtcctttaccctttttacctacccttaccccgtttcgtaccctttacgttcggggaccctacgttaccggtaacccccgggtacccg

SEQ ID NO: 103905 - DNA, 643 bp, Homo sapiens
  misc_feature: GYAE6OF01C62IZ.17.34.D01.1.454.CMB.1.raw
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagccctacccgcttaaaccgggacaaccgtcgcccggccaaacatacgccttcctcccgtccccccttcgcagtaacaccaagtacaggaatattaacctgttccatcgactacgcctttcggcctcgccttagggcactcacctgccccgtattaacgtggacacggaacccttggtccttccggcgacggccgggtcttttccgaccccgtcttttanccgtttaactttagtcgtcagtcatttcgctactttccngactacctcacgcatcgcctcaacacgcaactaccttcaacacggtcttaacgaacgaccgtacccttaccccctaacccaaaccaacgtacaagtaacggccgttaccgcgtacgcccgcacgtcgttccgggagctagttcggtttaccggtccccttttgaccttcccttaccccgcctaatccttgtaacctgtctaccg

SEQ ID NO: 103906 - DNA, 561 bp, Homo sapiens
  misc_feature: GYAE6OF01DLNMW.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaggatcgtcctatcgttgacacacaaactcgcacagagtcaggcagactcaccataaccgcggaacaaacttaacgaacaacaagttaatcgtaggagactagaacagcctgtcatctagaggacgacgggtcttactacttcgtgtgacgtaggtataattactatactatgtaccttaccttttacctcccttcccttagtacctttcgtacgggacctacgtccggtacccccgtaccg

SEQ ID NO: 103907 - DNA, 810 bp, Homo sapiens
  misc_feature: GYAE6OF01CX8AE.17.34.D01.1.454.CMB.1.raw
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttnagcgatatagtttcaagtttgggtcgcggacgggtccctcgtggaacaagggtccctttaggagtgggagtacgggggaaggacttccggtaccccgttaagtccggtttacggaaccaaccaaccctaaaaccgttacgacctaacgaacggtaaacggttcccgaaggggaccaaggtaacctaccgaacccgtaacgtaaaccccggacgggaaacctaaaaacgttaaaccgtaaaccgaaccgtaaggtttaaacgtaccgttaagggaacgtaccttaacggaaaccgtacgtacccgttcgtacacgttaccgttagggaacgggtaaccgtaaccggggttccttttaccgtttaacccgtttcgttggttacggtaccgggtaagggtaacgttaaaacgtttaaccttaaacttaaaccgtaaccgttacgttaccccttttaacccttttttaccctaccccctttcccgtttacgttacccgtttaccggttaccgggggtaccctaaccggttcccgggtaaccccccggttacccg

SEQ ID NO: 103908 - DNA, 659 bp, Homo sapiens
  misc_feature: GYAE6OF01DIKFX.17.34.D01.1.454.CMB.1.raw
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggacggctaccttcagcgaactatagtttcaattgggngcgacgggctcgtggacaaggccttaggacgtggagtgggagtatccgtacctattcgtanacgacaactaactacgctacgaagtacgttcgaggtacacgtacctacgaaccctaagtaacccgacggaactaaaacgttaacgaaaccgactaacgtttaagtaccgtaggactacgtagaaacctagtccctagtcactcgtagacgaacggtaccggtcttcgttacttcgtgtacgtacgtaagggtacttaagttaactaactaaactacttacgtacctttccctttttaactacccctttacccgttcgtaaccgtttcggtacgggttaccctaacggttccggtaaccccccggttacccg

SEQ ID NO: 103909 - DNA, 668 bp, Homo sapiens
  misc_feature: GYAE6OF01EQQLY.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcggacggcctctggacaaggccttgaggtggagtggggaagtntcgtccctatcgtgacacaccaaactacgcacagtaagtcgaaggcagactacacaacgtaaccgacggaacaaattaacgaacactaagttaactcgtaggagacgtacgaacacgtacctcgtacatcgtaggaacggaacgaccgggtacctttacgttacctttacgtggtacggtacggtaacggtaagttaaacttaacttaataaacccgtacgttacgttacccttttaacccgttttttaaccctacccctttacccgtttacgtaccctttcggtaccggggtaccctaacggttacccgggtaaccccccggttccgtaccccggttaccccg

SEQ ID NO: 103910 - DNA, 835 bp, Homo sapiens
  misc_feature: GYAE6OF01B0RMR.17.34.D01.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggagtagacgcgtcggtcgtcgtggtggcgtctcgngacgagtcttggnggcgctacctgacgacgtatagttcttacgtaggttggacgcggtaccgtcctggtacggaacgtaccggtcgtaggtaggtaggtacgggtaggggaacgtacggttccccgtaccgttcgttacggttaacgaaccctaacccgtaaaaccgtaaaccgaccgaccgaaacggtaaacggttaacccgttaccgggacggaccgtaacgtaaccctacccgaaaccgtaaacccggtaacccgggaaccgtaaaacttaaaacggtaacccgaaccttaacgttaaacggttactcgggtaaggaccttagaaaccgaacggtcccgtccgttacgacttaccgtcggaacgggacgtaacccgggacgttttcccttaaccttttccgtaggttaggtaccggaagggttaacggttaaactttaactttaaaccgttaaacgtacccgttacggttacccgtttccccttttttaaccgtttaacccccctccccgttttacggttacccgttacgtttcccggggggtacccggaacccctttacggggtaaacccccccggggttcccccttacccccggg

SEQ ID NO: 103911 - DNA, 644 bp, Homo sapiens
  misc_feature: GYAE6OF01CB48M.17.34.D01.1.454.CMB.1.raw
  modified_base (290)..(290): a, c, t, g, unknown or other
  misc_feature (290)..(290): n is a, c, g, or t
  modified_base (457)..(457): a, c, t, g, unknown or other
  misc_feature (457)..(457): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccagttggtgcaatcgtggggctgaggtgaagacgcgtgggtcctcggtgaggtctcctgcaggcttcgtggaggctaccgttcaggcgacttatagtttacaagtttgggngcgacggcctcgtggacagccgttaggaggtggagtgggaagtacgtccgttcctagtcgttacgaccacaccaaactcgacacgagacgtcgaggcacgactacaccagtaaccgcgaacaaacttaacgaactaactagttaactcgtaggacgtactagaaccncgtaccgtagtactatacgtagacggtaccgacgggtcttacgttcttacgtggtacgacgtaaggtaattaacgttaactactaacgttacttcgtttacctttacccttttaaccctccctttcccgttagttacccgttcggtaccgggacccttaacggtccccgggtaacccccgttacccg

SEQ ID NO: 103912 - DNA, 742 bp, Homo sapiens
  misc_feature: GYAE6OF01D9YIG.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgatttttccggatttgcctaggaaaaccagcctacccgcttaaaccgggacaaccgtcgcccggccaacatagccttctcccgtcccccttgcagtaacaccaagtacagaatattaacctgttcccatcgactacgcctttcgcctcgccttagggtcgactcaccctgccccgtattaacgttcggacaggaacccgttggtccttccggcgagcgggcttttcgacccgtctttactcgttacttatgtcagtctattcgctacttctcgtactacctccagccatcgccctacacacgccaactacccttacacgtacggtacttaaccacgtaaacccgtaccccttaccccctaaacccctaaacgaaacccgtacgaaacttaaaccggcccgttaccgtacccgttaccggccccgaccgtaccggttcccgtttaccgggtacgttccgtaaaggttttcccggggtttttaacccggttccccccggttttttacccaacccgtttcccccgtttaccccccggtacccttaactttcccgttacggttaaacccgtttacggtacccgttaacccggg

SEQ ID NO: 103913 - DNA, 849 bp, Homo sapiens
  misc_feature: GYAE6OF01CS396.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacggcctcgtggacaaggtccttggagtggagtagggtaaggagtcgttaccccgtagttcgttgaacgaccaacccgaaaaccttacgaccaaccgaagaaacgtttaccgaagggacgacggaacctccgaaccaacgtaaacccgtacggaactaaaactttaaaaccggaacctaaacctaaagtttaaacgtacgttaacgggtaacgtaaccgttaacggaaacccgtaacgggacccttacggttacccgtaacgttacccgttagggaaaccgggaacccggttaacccgggggtacccttttaaccgttaacccgttttaaccggtttcggttacgggtaccggtaacggggtaacgtttaaaacgttttaaaccgttaaaccgttaaaaacccgttaaccgttacggtttacccgttttaaccccgtttttttaaccccgttaaaccccgttttaccccccgtttacggttaacccgttttacccggttacccgggggttaccctaaaccggtttaaccccggggtaaacccccccggtttaacccccggg

SEQ ID NO: 103914 - DNA, 772 bp, Homo sapiens
  misc_feature: GYAE6OF01DAU10.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggacggcaccttcagcgactatagtttcaagttgggtgcgacgggcctcgtggacaaggtccttggagttggagtggggaaggtatccgtcctatccgttagaaccacctaaccaaaactcgacaacaggaacgttccgaaggggtcaaggacctaccaaccctacgtaaaacccggacggaaacctaaaaacgtttaaaccgaaacaacgtaagtttaaacttacgttacgggaacgtacctaggaaacctaacggcccttagtacctaagttcgtaggaacggtaacgtaacccggggttactttaccgttaacctttccgttaggttacgggtacggtaaaggtaacggtttaaacttaacgttaaacgttaaaccgtaaccgtaccgtttacccgtttaaccccttttttaacccgtaaccccttttaccccgtttacgttacccgttttacggttaccggggtacccctaacgggttaccccgggtaaaccccccggttcccgttaacccccggtttacccc

SEQ ID NO: 103915 - DNA, 588 bp, Homo sapiens
  misc_feature: GYAE6OF01BMGDX.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttgagtggagtgggagatcgtcctatcgttgacacaccaaactcgcacagaacgtcaggcagactcaccactaacgcggaacaaattaacgaacacagttaatcgtaggagactagaacacgacctagtacatcgtggacggacgacgggtcttctacttcgtgtagacggtagtagttaattactaataacacttcgtacctttaccttttacctacccttcccttacgtaccgttacgtaccgggtcctacgtaccggtaccccgtccgtaccgttccccg

SEQ ID NO: 103916 - DNA, 577 bp, Homo sapiens
  misc_feature: GYAE6OF01B5ENS.17.34.D01.1.454.CMB.1.raw
  modified_base (390)..(390): a, c, t, g, unknown or other
  misc_feature (390)..(390): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggatgttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacggcctcgtggacaaggccttggagtggagtgggaaggatcgtccctatcgttgacacaccaaactaccgacacagacgttccgagggcagactcaaccganaaccgcgaacaaacttaacgaaacactagttaatctaggagctacgaactagccgtgtacatctagacgacgacggtccttactacttcgtgtcgcgaggtagtaattactaataactacgtcgtaccttccttttacctacccttccttacgtacttccgtgggacctacgtcgggtaacccccgg

SEQ ID NO: 103917 - DNA, 847 bp, Homo sapiens
  misc_feature: GYAE6OF01B28V5.17.34.D01.1.454.CMB.1.raw
tcagcgtagactagcacgaccggtgctcgatttagatcgtctgtgttgggtttggggatcacaaaacaaccagtattccgtcctcgtaaagaagcccctgggagcgacagctcatacaccatggactggacctggaggttcctctttgtggtggcagcagctacgaggtgtccagtccaggtccagttggtgacaatcgtggggctggaggtgaaggccgaccgtgggtcctcggtcgacggtcctccgtgccgaacggccttcggtgggacggtcctacccttccgacggccgaaccttagttacgtttcgaagttgggtacgaccggacgggcctacgtcggaacgaacgggtccttggaggtggaggtcggggaaggtacgtaccggttccttacgttcgttgaaccaccgtaacccgtaaacgtaccggaccgaacgtaacgggtaaaccgttacccggaacggggtaccaacggtaaccctaccgtaaacccgaacgttaaaccccggaccgggtaaacctaaaacgttaaacccggtaaactaaccgttaacgtttaaacttacgtagggtaacgtaccgttaaggaaaacccgcgtacccgttacggttacccacgtttaccgaggtaacggaaccgttacggggtccctttaccgttaacctttcgtacgggttacggtacggtaaggtaacgtttaaacgttaactttaaacgttaaaccgtaccgttacgttacccgtttttaccccttttaaccttaccccctttacccgttaccggttacgttcccggtacggggtaaccctaccgggttaccccgggtaacccccgttaccccg

SEQ ID NO: 103918 - DNA, 619 bp, Homo sapiens
  misc_feature: GYAE6OF01CBKLJ.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattaacgtggacaggacccttggtcttccggcgagcgggcttttcacccgtctttatcgttacttatgtcagcattcgcacttctgactacctccagcatgcctcacacgcacaccttcacacggtcttaacagaaccgcctacccctaacccaacaaccgcaactaacgccgtcgctcgcccgcacgtccgttcggcgtcctaagttcgggttttaaccgtcccccggttttacaccgtttcccttccccgccctacgttcctacgtaccttacggttccgtaacccgg

SEQ ID NO: 103919 - DNA, 562 bp, Homo sapiens
  misc_feature: GYAE6OF01DHTAH.17.34.D01.1.454.CMB.1.raw
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (424)..(425): a, c, t, g, unknown or other
  misc_feature (424)..(425): n is a, c, g, or t
  modified_base (429)..(429): a, c, t, g, unknown or other
  misc_feature (429)..(429): n is a, c, g, or t
  modified_base (433)..(434): a, c, t, g, unknown or other
  misc_feature (433)..(434): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcgggtgacgggtctcctgacaaggcttcgtggaggcctaccttcagacgtactagtagtttcaagttgggtgccggacgggcctcgtggacaaggtccttgagtgggagtggggaaggtatccgtcctatcgttgacacaccaaactacgacacagaagttccaggcagactcacataccgngaacaaataacganacattanngacnagannctnctncngagacacggtcttctactctgtgcgagattaatactatactatctacttcctttaccaccttcccgttcgaccgtttcgacgggtcctacgtacccggtaacccgtccgtacccgtcccg

SEQ ID NO: 103920 - DNA, 546 bp, Homo sapiens
  misc_feature: GYAE6OF01CBG9Y.17.34.D01.1.454.CMB.1.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacgggcctctggacaaggccttggagtggatgggaagntcgtcctatcgtgacacaccaaactcgcacagaacgtccaggcagactcaccataaccgcgaacaaataacgaacactagttaatcgtaggagactagaacagctgtcatctgaggacgacggtcttctacttctgtgcgagtataattactaatacatcgtcttaccttttactccttcccttgtacttcgtacgggtaccacgtccggtaccccggtaccg

SEQ ID NO: 103921 - DNA, 605 bp, Homo sapiens
  misc_feature: GYAE6OF01CUR6B.17.34.D01.1.454.CMB.1.raw
tcagcgtagactagcacgaccggtgctcgatttagatcgtctgtgttgggtttggggacaaaacaaccagattcctcctctaaagaagcccctgggagcacagcctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacgggtcctcgtaggacaaggccttgagtggagtgggaagatccgtcctatcgttgacacaaccaactacgcacagaacgtccgaggcagactcaccataaccgcgaacaaattaacgacactagttaactcgtaggagacgtagaacacgcctgtcatcgtgacggtacgacggtcttctacttcgtgtgcgaggtagttaacttacgtaactaactactcgtccttacccgtttttaccaccctttacccgttacgtacccgtttcgtcgggtacccttaacgtacccgggtaacccccgtccgtacccggttcccg

SEQ ID NO: 103922 - DNA, 619 bp, Homo sapiens
  misc_feature: GYAE6OF01BV1W5.17.34.D01.1.454.CMB.1.raw
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaacgtccagggcagactcaccataaccgcganaaatacgaacacagtaatctganctagaacagctgtacatctagaggacacgggtcttactacttcgtcgtgacggtaaggtaagttaacttaacgtaacttaaactacttacgtaccgtttaccctttttttaaccaccccctttacccctttcgtacccttttccggttacgggggtacccctacgttacccgggtaaaccccccgggttcccgtaaccccggtttccccg

SEQ ID NO: 103923 - DNA, 578 bp, Homo sapiens
  misc_feature: GYAE6OF01EZY2M.17.34.D01.1.454.CMB.1.raw
  modified_base (291)..(291): a, c, t, g, unknown or other
  misc_feature (291)..(291): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggcctcnggacaagccttgagtggatgggaaggactcgtccctatcgttgacacaccaaactacgcaacacgaaagtccagggcagactcacactaaccgcggaacaaataaccgaacaacaagttaactctggagctagaacagcctgtcatctagaggtacgacgggtcttcgtaacttctagtgacgtagtaagttaacttactaataacacttcgtaccttcccgttttactacccttcccttcgtaccttcgtcgggtacctacgtacggaccccggtctacccggtcc

SEQ ID NO: 103924 - DNA, 876 bp, Homo sapiens
  misc_feature: GYAE6OF01BZNKL.17.34.D01.1.454.CMB.1.raw
  modified_base (806)..(806): a, c, t, g, unknown or other
  misc_feature (806)..(806): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctcgggtggagggtctccgtagcgaagggtctttcgtgggacggtcctaaccgtttcgacggtaccggtaaccttagtttaggttttaccgaaaggtttttggggggtaacggccgggtaaccgggggtccctttcggttacgggggtaaaccgaaacggggtcccttttagggaaaggttcggggtaaggttaggggggaaacgggttaactttccccgggtacccctttaaagttccggtttacggaaaccctaacccaaaacccgtaaaaaccgttaaccggaccaaacgtaaacggtaaacggtttacccggaacgggactaacggaacccgttaccaaacccgtaaacgtaaccccggaacgggtaaacctaaaacgtttaaacccgaacgtaaacctaaggtttaaaccgtcgttaagggaacgtcgtaaacggaaaccgtacgacccgttgtacctagtacgtaacggacgggtaaccgtacgggttccttagttaccgttacgtggtaacggacgtaaggtaacgttaacttaactaacgtaaccttacgtaccgtaccttttacccgttttaaccncccgtttacccgttagttaccgtttcggtaccgggtaccttaacggttccccgggtaacccggttacccg

SEQ ID NO: 103925 - DNA, 649 bp, Homo sapiens
  misc_feature: GYAE6OF01DGYB6.17.34.D01.1.454.CMB.1.raw
  modified_base (289)..(289): a, c, t, g, unknown or other
  misc_feature (289)..(289): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctcgggtgagggtctccgtgcaaggtcttcgtggaggcaccttcagcgactatagtttcaagttgggngcggacggcctgtggacgaggtccttggagtggagtgggaagctcgtacctagtcgtagacacaacaactacgacaacgagtacgtcgaggcagactacaccaagtaccgacgaactaaagtaacgaacactaagtaactcgtaggacgacgtagaacacgtccgtagtacagtcgtagacggaccgtacggtcttactacgttcgtagtacgacggtacggtagttaacttaacgtaactaaaccgtacttaccggttaccctttacccgtttttaaccctacccctttacccgttacgttacccgtttaccggtacgggtacccgtaccggttacccgggtaacccccggtttacccg

SEQ ID NO: 103926 - DNA, 627 bp, Homo sapiens
  misc_feature: GYAE6OF01EPYU3.17.34.D01.1.454.CMB.1.raw
  modified_base (382)..(382): a, c, t, g, unknown or other
  misc_feature (382)..(382): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggatcgtcctatcgttgacacaccaaactacgcacagaagttccagggcagactacacaanaaccgcggaacaaacttaacgaactaacagtttaatcgtagaacgctggaaacagccctagtacatacgtgaacggacaacgggtcttaccgtactttacctgtaggaccgtaagggtaagttaaacttaacgtaacttaaacctaacttcgtcctttaccctttttaccctaaccctttccctttaggtacccttacggttaccggggtaccctacggttacccgggtaacccccgggttaccg

SEQ ID NO: 103927 - DNA, 536 bp, Homo sapiens
  misc_feature: GYAE6OF01AJ9PA.17.34.D01.1.454.CMB.1.raw
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcggtgagggtctcctgcaaggcttctggaggcaccttcagcgactatagttcaattgggtncgacgggcctctggacaaggccttgagtggatgggaagntcgtccctatcgttgacacaccaaactacgcacagaagttccagggcagactcacataaccgnggacaaataacgaanacagttaanctagagctnaacagctgtcatctgagacacgggcttactacttctgtgcgaggagtaattactataaacatgctacccttttacacccttccttagactttcgcgggacactcggaacccccggtac

SEQ ID NO: 103928 - DNA, 652 bp, Homo sapiens
  misc_feature: GYAE6OF01B4Q6N.17.34.D01.1.454.CMB.1.raw
  modified_base (338)..(338): a, c, t, g, unknown or other
  misc_feature (338)..(338): n is a, c, g, or t
  modified_base (469)..(469): a, c, t, g, unknown or other
  misc_feature (469)..(469): n is a, c, g, or t
  modified_base (595)..(595): a, c, t, g, unknown or other
  misc_feature (595)..(595): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagacgctgggtcctcggtgagggtctccgtgcaaggcttcgtggaggctaccttcagcgaacttagtagtttcgaagttggggtcgcggtacgggcctcgtggacaaggtccttggagtggagtgggaagtntcgtcctagtcgttagacacaaccaaactacgcaacgagaacgttccgaagggaccagtacctacgaaccagtaaacccggacggaaactaaaacgttaaccgaaacaacgtaagttaaactcgtaagganacgtaagaacagcctagtctatcgtagaggaaccgtacgggtctttaccgtacttacgttggtacggacggtaaggtaacgttaaacttacgtaactacgtaccgttcgtacctttaccctttacncccctttaccttgtaccgtttcggacggtaccctacggtaccggtaccccgttaccg

SEQ ID NO: 103929 - DNA, 592 bp, Homo sapiens
  misc_feature: GYAE6OF01EBKCT.17.34.D01.1.454.CMB.1.raw
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
  modified_base (548)..(548): a, c, t, g, unknown or other
  misc_feature (548)..(548): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactattagtttcaagttgggtgcgacgggcctgtggacaaggccttgaggtggagtgggaagatcgtcctatcgtgacacaccaaactacgcacagaacgttcgaggcagactcaccaataacccgnggaacaaacgttaacaacactaagtaatacgtagganctagaacagcctagacatctaggacgacgacggtcttacttacttcgtgtcgacgtaggtagttaacttactaataacctaccttgtaccctttaccgttttaaccaccctttcccgttntaccgtttcgtacgggtacctacggtccggtaccccggtacccg

SEQ ID NO: 103930 - DNA, 609 bp, Homo sapiens
  misc_feature: GYAE6OF01AT6XF.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcaaggcttcgtggacggctaccttcagcgactatagtttcaagttgggtgccggacggcctcgtggacaaggtccttgaggtggagtgggaagatcgtccctatcgtgacacaccaaactcgcacagacgtcgaggcagactcaccataccgacgaacaaacttaacgaaccactaagttaactcgtaggagactagaacacgtcctacgtactactcgtaggacgacgacggtcttacgtcttctgtcgtacgaaggtacttaagtactaataccacttacgtacctttacccgttttaccacccttccgttctaccgttcgtcgggtaccctaacggtcccgggtaacccccgtccgtaacccgttcccg

SEQ ID NO: 103931 - DNA, 579 bp, Homo sapiens
  misc_feature: GYAE6OF01A9HXM.17.34.D01.1.454.CMB.1.raw
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
  modified_base (410)..(410): a, c, t, g, unknown or other
  misc_feature (410)..(410): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaatctggggctgaggtgaagacgccgtgggtcctcggtgagggtctccgtgcaaggcttcgtggaggctaccttcagcgactatagtttcaagttgggncgacggcctgtggacaaggccttggagtggagtgggagntcgtcctatcgttgacacaccaaacgtcgcacagaagtcaggcagactcactagaccgcgaactaataacgaacacagttaancgtaggagactagaacacgtcctagtactatcgtagaggacgacggtcttactacgttcgtagtcgacgtaggataacttactaacgtactacgttcgtacctttacccttttacacccttccgttagtaccttcggtcgggtaccctagtcccgggtaccccgtaccg

SEQ ID NO: 103932 - DNA, 849 bp, Homo sapiens
  misc_feature: GYAE6OF01CZNNP.17.34.D01.1.454.CMB.1.raw
  modified_base (253)..(253): a, c, t, g, unknown or other
  misc_feature (253)..(253): n is a, c, g, or t
  modified_base (733)..(733): a, c, t, g, unknown or other
  misc_feature (733)..(733): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtcctagttggtgcaatcgtggggctggaggtgaaggacgcgtgggtcctcgggtgacggtctctgcgaaggctttcgnggacgctaccttcgagtacgacttagttagtttacgtaagtttggggtcgaccggacgggtcccttacgtacgggaacgtaaacggtccgtttaggaaggtacgggtagtacgggggaaaggtcgttaccggttacccgttagttaccggttagaaaccgtaaccgtaaacccgtaaaaccgttaaccggaacccaaaccggttaaacgggaaaccggttttacccggaaacgggggtaacccaaaccgggtaaaccctttaacccgaaacccccggttaaaaccgtaaaccccggggtaaaccgggtaaaaccctttaaaaaaccgggtttaaaacccgaaaccgttaaaccggtaaccgttttaaacggtaccggtaacggtaacggtaccggtaacgtaaaccgtaccgtacccgttaggtaccctagtccgtaaggacggtaaccgacgggttcttaaccttcgtacgtcgtacgnggtagtaacgttaacgtactaacgtaacctgttacgttaccttactttaaccctccgtttaccgtttacgttacccggtacggtacctaacgttcccggtaccccgtcgtaccccg

SEQ ID NO: 103933 - DNA, 565 bp, Homo sapiens
  misc_feature: GYAE6OF01DT5ZT.17.34.D01.1.454.CMB.1.raw
  modified_base (282)..(282): a, c, t, g, unknown or other
  misc_feature (282)..(282): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctgggtcctcggtgagggtctcctgcaaggcttctggaggcaccttcagcgactatagtttcaattgggtncgacgggcctctggacaaggccttgagtggatgggaagatcgtcctatcgttgacacaccaactacgcacagaagttccagggcagactcaccataaccgcggaacaaattaacgaacaacaagttaatctaggagactagaacagcctgtacatctgaggacacgggtcttctacttcgtgtgcgaggtagtaattacgtaataactactagtcctttccttttacctacccttcccttgtacctttcgtcggggacctacgtccggtaaccccggtacccg

SEQ ID NO: 103934 - DNA, 564 bp, Homo sapiens
  misc_feature: GYAE6OF01EA6X4.17.34.D01.1.454.CMB.1.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaagttgggtgcgacggcctntggacaaggccttgagtggagtgggagntcgtcctatcgtgacacaccaactcgcacagagtccagggcagactcaccataaccgcggaacaaattaacgaacactaagttaactacgtaggagtactagaacagcctgtcatctagacggacgacgggtcttctacttctgtgcgtagtagtaacttactaataacactacgtcttaccttttacctacccttccttcgtaccttcgtacggtcctacgtaccggtacccgtctcccgtcc

SEQ ID NO: 103935 - DNA, 595 bp, Homo sapiens
  misc_feature: GYAE6OF01CZP0Y.17.34.D01.1.454.CMB.1.raw
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (442)..(442): a, c, t, g, unknown or other
  misc_feature (442)..(442): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcgggtgagggtctcctgcaaggcttctgggaggcaccttnagcgactatagtttcaatttggggtncggacggcctcgtggacaaggtccttgagtggatggggaagatcgtccctatcgtgacacaccaaactcgacacagaacgttccgaggcagactcaccataaccgcggaactaaacgttaacgaacactaagttaactcgtaggagactagaaccncgtcctgtacagtctaggacggacgtaccgggtcttactcttcgtgtgacgaggtataacttactataacgtactcgtcctttacttttacccgaccctttccgttagtaccgttcggtacgggtacctacggtcccggtaccccgttacccg

SEQ ID NO: 103936 - DNA, 585 bp, Homo sapiens
  misc_feature: GYAE6OF01B6A8O.17.34.D01.1.454.CMB.1.raw
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (426)..(426): a, c, t, g, unknown or other
  misc_feature (426)..(426): n is a, c, g, or t
  modified_base (526)..(526): a, c, t, g, unknown or other
  misc_feature (526)..(526): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctntggacaaggccttgngtggagtgggaggatcgtcctatcgttgacacacaactacgcanagaacgttcagggcagactcaccataccgacgaactaataacgaacacaagtaatcgtggagcgtagaacngccgtatcatctaggacgacgcgggtcttactacttcgtggtgtacggtaggtacgttaattaacgtactaactacgttcgtcctttacccttttacccncccttacccttcggtactttccggtcgggtacctacggtccgggtacccccggttaccg

SEQ ID NO: 103937 - DNA, 629 bp, Homo sapiens
  misc_feature: GYAE6OF01DKLDN.17.34.D01.1.454.CMB.1.raw
  modified_base (286)..(286): a, c, t, g, unknown or other
  misc_feature (286)..(286): n is a, c, g, or t
  modified_base (440)..(440): a, c, t, g, unknown or other
  misc_feature (440)..(440): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtncgccaggccgctaggacaacgcctgagtggatgggatgggaccaaaccctaacacgtggtgtcactagttcgtcttccacccactcccgtaccggggacgtacttaccgatacgacccaacgtaacctccctaccaataaaccacacgacctanagtggtagttcggaagacgcctagactacgtcgtaacggaccgaaccgccgggtacccgttacttactttaacggtggtacggaccggtaaggtacccggttaccccgaaggtaccgtcccgggtaggacccgaccccgtacggccgtacggtcccggttccttttaaggccggtttcgggaccggggg

SEQ ID NO: 103938 - DNA, 713 bp, Homo sapiens
  misc_feature: GYAE6OF01BDZUZ.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgccgtgggtcctcggtgagggtctcctgcaaggcttcgtggaggctaccttcagcgactatagtttcaagttgggtgcggacgggcctcgtggacaaggccttggaggtgggagtgggaaggtatccgtcctagttcgtagacacaaccaaactacgacagagtaacgtccgaaggcagactccaaccaagtaaccgacggaaactaaaagttaacgaaactaacgtaagttaaacgtcgtagggtaacgtacgtaagaaccgacgtccgttagtcgtaactcgtacggaacggaccgtacgggtacctttacgttaaccttcggtacggtcggtaaccggtaaggttaaacgttaaatttaaccgtaaacgttaaaccgtacgtttaccgttaaccctttttaccccgtttttaaaccctacccctttcccgtttacgttacccgtttcggtaccgggtaccctacggttacccggtaaccccccggttcgtaccccgttaccccg

SEQ ID NO: 103939 - DNA, 606 bp, Homo sapiens
  misc_feature: GYAE6OF01BIRH2.17.34.D01.1.454.CMB.1.raw
  modified_base (322)..(322): a, c, t, g, unknown or other
  misc_feature (322)..(322): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagctagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggcctcgtggacaaggccttgagtggagtgggaaggntcgtcctatcgttgacacaccaactacgcacagaagtccagggcagacctcaccagtaaccggcggaacaaacttaacgaacacagttaancgtagatctagaacagcctgtacatctagacggacacggtcttcgtacttcgtcggtagacggtaggtacttaattacgtaagtaactacgttacgtacctttaccgttttaccacccctttccgttcgtaccgtttccgtacggggtaccctacggttacccgggtaacccccgttcgtaccccgttccccg

SEQ ID NO: 103940 - DNA, 573 bp, Homo sapiens
  misc_feature: GYAE6OF01BWIWN.17.34.D01.1.454.CMB.1.raw
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttggagtggagtgggaagntcgtcctatcgttnacacaccaactacgcacagaagttccgaggcagactcaccataccgacgaanaataacgacacaagttatctagacgctagaacagacctgtacatctagacggacgacgggtcttcgtacttcgtgtcgtacgaggtaatattaacactaacgtacttcgtcctttaccttttaccaccttccttcgtaccttcgtacggtacctacgtaccggaccccgtcgacccgttcccg

SEQ ID NO: 103941 - DNA, 703 bp, Homo sapiens
  misc_feature: GYAE6OF01BTN3A.17.34.D01.1.454.CMB.1.raw
  modified_base (357)..(357): a, c, t, g, unknown or other
  misc_feature (357)..(357): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctccgtgcaagggtcttcgtggacggcaccgttcagtccggaacttagttagttttcaaagtttcggggtagccggacggggccctcgtcgggacaagggcctttggaggtggatggggaaggntcgtccctatcgttgaccacaccaaactaccgcacagaagttccgaggcacgactcaaccataacccgngaacaattaacgaacacagttaactcgtaggacgtctagaaacgacgcccgttagtaccagtacgtacgaacggtaccgacgggtccttacgttacgtttccgtacggttagccggtaacgggtacgttaaacgtttaacgtaaacgttaaacccgactttacggtacccttttacccgttttttaacctaccccgtttaccccgtttacggttacccgtttcccggttacggggacccctttaacggttacccgggtaacccccggttaaccccgg

SEQ ID NO: 103942 - DNA, 574 bp, Homo sapiens
  misc_feature: GYAE6OF01D9VZM.17.34.D01.1.454.CMB.1.raw
  modified_base (248)..(248): a, c, t, g, unknown or other
  misc_feature (248)..(248): n is a, c, g, or t
  modified_base (355)..(355): a, c, t, g, unknown or other
  misc_feature (355)..(355): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaagttgggtgcgacgggcctctggacaggtcctgagtggatgggaagatcgtccctatcgttgacacaccaaactcgcanagaagtccaggcagactcaccataaccgcgaacaaattaacgaacacaagtaatcgtagagactagaacagcctgtcatctgagacacgggtcttactacttcgtagtcgacgaggtagttaacttactaactaacgtactacgtccttaccttttacctcccttacccttacgtaccttcgttacgggtacctaacgttccggtaccccggttacccg

SEQ ID NO: 103943 - DNA, 780 bp, Homo sapiens
  misc_feature: GYAE6OF01B4E4C.17.34.D01.1.454.CMB.1.raw
  modified_base (264)..(264): a, c, t, g, unknown or other
  misc_feature (264)..(264): n is a, c, g, or t
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttgtggtggcagcagctacaggtgtccagtcccaggtccagttggtgcaatcgtgggctgaggtgaagacgcctgggtcctcggtggagggtctcctgcaaggtcttcgtggacggcaccttnagcgactaatagtttcaagttgggtagcgacggcctctggacgaaggtccgtttaggagtggagtaggggaagtacgtacgtccctagtcgtttacgaaccaaccaaccaaaaccgtaccgacaaccgtaagaacgttacgacgggacacgaacctaccgaaccgtaacgtaaacccggaacggtaaacgtaaaacgttaaacccgtaaaccaaacgttaaacggtttaaactaccgtaacggtaaacgacgttaaacggaaacctaacggtaccttaacgggtacctacttaccggttaaggaacggtaacccggtaacgggtacctttaaccgttacgttacccgttggtaaccggtacggtaaggtaacgttaaacgttaccgtaaattaacccgtaaccgtagttacccttttaccgtttttaaaccctaccccgtttaccgtttaaccgtacccgtttacggttaaccggggaccctttaacgggtaccccggttaaccccggttaacccg

SEQ ID NO: 103944 - DNA, 628 bp, Homo sapiens
  misc_feature: GYAE6OF01D2FV4.17.34.D01.1.454.CMB.1.raw
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttgtgcaatcgtggggctgaggtgaagacgcctgggtcctcggtgagggtctcctgcaaggcttcgnggagctacttcagcgactatagttcaatttgggncgacgggtcctctggactaaggccttggagtggatgggaagntcgtcctatcgttgacacaccaaatcgacacagtaagtccagggcaagactacaccagtaaaccgcggaaataaacttaacgaactaccaagttaatacgtggacacgtagaaccgagtaccctgtacagtcctaggaacggacgtacgggtactttcttaacgttcgtgtcgacgtaggtaagttaacttacttaagtaaacctacgttcggttcccttaaccgtttttaccaacccgttaccccgttagtacccttttacggtacgggtacccttaaggtccccggtaaccccggtaccccg

SEQ ID NO: 103945 - DNA, 793 bp, Homo sapiens
  misc_feature: GYAE6OF01BYI00.17.34.D01.1.454.CMB.1.raw
  modified_base (684)..(684): a, c, t, g, unknown or other
  misc_feature (684)..(684): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccagtccagttggtgcaatcgtggggctggaggtgaacgacgcctgggtcctcggtggtaggtctcgtgcgaaggtcttcgtggacggctaccgttcacggcgtacttatagttttacaagttgggtgcggacggcctcgtggacgaggtccttggagtggagtagggagtatccgtcctagtcgttacgacaccaaccaaactacgacaacagtaacgtcgaacggtcaacgactaccaacctaacgtaaaccccggacggtaaaaacctaaaacgttaaaccggaaacctaacgttaacggtttaaaacgtccgtaacggggtaacgtacccgttaagggtaaaccaccggtaccgttagttaccgtaagttaccgtaaggaacgggaccgtacgggttaccttttacgtaccgtttcgtacggtgtaaccgggtaaaggttaacgtttaaaccgtaacgttaaacctaacgtaaacccgtttcgttacccgttttaccccgtttttaaacccncccccgttttccggttaacccgtttaccgtttcccggggtacccggttaacccgtaacgggttaccccccggttaaaccccggttccccgtaaccccggtttacccccg

SEQ ID NO: 103946 - DNA, 572 bp, Homo sapiens
  misc_feature: GYAE6OF01EX0QR.17.34.D01.1.454.CMB.1.raw
  modified_base (321)..(321): a, c, t, g, unknown or other
  misc_feature (321)..(321): n is a, c, g, or t
  modified_base (521)..(521): a, c, t, g, unknown or other
  misc_feature (521)..(521): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacggcctgtggacaaggccttgagtggagtgggaagntcgtcctagtcgttgacacaccaaactacgcacagaacgttccgagggcagactacaaccagtaaccgacgaacaaattaacgaacaactaagttaatcgtaggagactagaacagcctgtcatcgtagaggacgacggtcttactacttcgtgtgacgaggtagttaatactaactaacactcgtcctttacctttacncccttccttagtaccgttcgtacgggtacctacgtccggtaccccggtccg

SEQ ID NO: 103947 - DNA, 663 bp, Homo sapiens
  misc_feature: GYAE6OF01B3YC3.17.34.D01.1.454.CMB.1.raw
  modified_base (453)..(453): a, c, t, g, unknown or other
  misc_feature (453)..(453): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcgggtgaggggtctccgtgcgaaggtcttcgtgggaggccaccttcagcgacttagtagtttcaagttgggtgcggacggggcctcgtggacaaggtccttggagtggagtagggaagtactcgtccctagtcgtcgacaacaaccaaactacgcaagaagtaacgtcccgagggacagactacaaccaactaacccgacggaactaaaataaccgaaacacgtaagttaancgtaggaagtctaacgaacacgtccctagtacatacgtaggacggaacgacgggtccttacttacgttgtcgtaggtacgtaaggtaattaacttactaacgttaacctactacgtacctttacccgttttaccaccctttaccgttcgttaccgttccgggtacgggttacctacggtacccgggtaaccccgtccgtacccggttccc

SEQ ID NO: 103948 - DNA, 590 bp, Homo sapiens
  misc_feature: GYAE6OF01EL809.17.34.D01.1.454.CMB.1.raw
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtccgcaatctggggctgaggtgaagacgcctgggtcctcggtgagggtctcctgcaaggcttcgtggaggccaccttcagcgactatagtttcaagttgggtgcggacgggcctcgtggacaaggtccttggagtggagtgggaagntcgtccctatcgttgacacaccaaactcgacacagaagtccgaggcagactcacanaaccgcgaacaaataacaacacagttaatctagagctagaacacgcctgtacatcgtagacgacgacggtcttactacgttcgtgtcgacgtaggtagttaattactaatacctacttcgtcctttacccttttacctacccttcccttacgtaccgtttccgtacgggtaccctacggtcccgggtaacccccggttcccg

SEQ ID NO: 103949 - DNA, 713 bp, Homo sapiens
  misc_feature: GYAE6OF01CR2WU.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgcctgggtcctcggtgagggtctccgtgcaaggtcttcgtgggacggcctaccgttcacgcgtacttatagtttcaagttgggtgccggacgggtcctcgtcggacaacggtccttggacgtaggagtaggggaacgtctccggtcctagtcgttagacctacaccaactacgacacagtaacgttcgaggtcagactacaaccgacgtaaccggacggaaactaaacgttaacgaacgtaacgtaagttaactcgtaaggacgtacgtagaactacgtacctagtaactcgtaggacggacgtacgggtctttacgttacgttcgtggtacgtacggtaaggtaagttaaacttaacgtaattaaaccgtactttacgtacccttttaccgtttttaacccgtacccgtttccccgttaggttacccgttttaccggtaccgggggtacccttaacgggttaccccgggtaacccccggttcctaccccggttcccgttaccccg

SEQ ID NO: 103950 - DNA, 712 bp, Homo sapiens
  misc_feature: GYAE6OF01CHHGC.17.34.D01.1.454.CMB.1.raw
  modified_base (143)..(143): a, c, t, g, unknown or other
  misc_feature (143)..(143): n is a, c, g, or t
  modified_base (168)..(168): a, c, t, g, unknown or other
  misc_feature (168)..(168): n is a, c, g, or t
  modified_base (705)..(705): a, c, t, g, unknown or other
  misc_feature (705)..(705): n is a, c, g, or t
tcagcgtagactagcacgaccggtgctcgatttagatcgtctgtgttgggtttggggatcaacaaaacaaccagattccctccctactaaaagaagcccctgggagcacagctcatcaccatggactggacctggagttcctntttgtggtggcagcagctacaggtntccgagtcccaggtcctaggtggtgacaagtccgtggggcttggagggtagaacgaccggtccgtcgggtccgtcgggtggacgggttcctccgtgacgaaggtcttacgtggacggctaccgttcgaggtcgtaacttagtacgtttacgaagtttggggcgccggacgggtcctcgtaggaaccgtaggtccttaggagtggaggtagggaagtcttccgtacctagtcgtacgaacaaccgacaaacgcgacaacgtaagtaacgtccgaaggacaacgtactacgaacaaacgtacccgaaacgtaactaaacgtaaccaaagaaccgttaagttaacctacggaagggttaacaccgtaaagtaaacgccgtacttagacctataccggtacgaagtaccgtacggtcctaccgtttctacgtagtcgaggttaagtacgtaattactacgaactcgtacctttccttaccgtttaccctcccgttttcttaacggttcgggtacgtaccgaccgttacccggtaacccgtntaccccg

SEQ ID NO: 103951 - DNA, 833 bp, Homo sapiens
  misc_feature: GYAE6OF01AQ7O9.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtggtcctcggtgagggtctcctgcaaggcttcgtggacgcacgttcagcgacttattagtttcgaagttgggtcgccggtaccgggcctcgtaggaaccgaacgggtcctttaggaggttagggaacgtagggggtaaacggtacgttcccggttaccccttagttccggttacggaacctaaacccgtaaaccctaaaaccgttaaccggacctaaaccgtaaacggtaaacggtttaccccggaaacggggtaccaaaccgggtaacccttaacccgaaaccccgtaaaccggtaaaccccgggtaccggtaaaacctaaaaaccgttaaaccgaaaccctaaaccgtaacgtttaacgtacgtacgggtaacgtacgtaacggaaacgaccgtacccgttaggtacctacgtacggtacggaacggaccggtaaccgggttactttaccgttaccgtttacgtaggtacggtacggtaaggttattaaacgttacgtaacgtaaccgttaccgttaccgttacctttacccgttttaacctacccgtttacccgttacgttaccgttaccggttacgggtaaccctacggttacccggtaacccccggttacccg

SEQ ID NO: 103952 - DNA, 849 bp, Homo sapiens
  misc_feature: GYAE6OF01CVWOO.17.34.D01.1.454.CMB.1.raw
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttgtggtggcagcagctacaggtgtccacgtcccaggtccagttggtgcaatcgtgggctggaggtgaagacgccgtgggtcctcgggtgacgggtcctccgtgacgaaggtccttcgtggacggcctaccttcgagtaccgtacttagttagtttacaaggtttgggcgtcggaccgggtcctcgtggaacgaacgggtcctttaggacggtggagtaggggaaggtacgttcccgtacccgtagttcggttacgacctaaccaacctaaaccgtacgacaaccgtaaggtaaaccggttcccgaaaggggcctaacggtaccctacccgaaacccgtaaaccggttaaacccggaccgggtaaaacctaaaacgttaaacccggtaaaaccgtaaaccgtaacggttttaaacgtaccggttaagggaaccgtacgtaaacggtaaccgtaacgtacccgttacgttaccgtacgttaccggtacgggaaccggtaccggtaccgggttaccctttaccgttaacgtttcgtcggttacggtacgggtaacgtaagttaaactttaaccgtaaacgttaacccgttacgttaccgtttacccgtttaccccgtttttaaccctacccccgttttacccgttacgttaccgtttcccgggtacgggttacccgtaaccggtaccccgggtaacccccggttaccccg

SEQ ID NO: 103953 - DNA, 606 bp, Homo sapiens
  misc_feature: GYAE6OF01CUFJN.17.34.D01.1.454.CMB.1.raw
  modified_base (256)..(256): a, c, t, g, unknown or other
  misc_feature (256)..(256): n is a, c, g, or t
  modified_base (321)..(321): a, c, t, g, unknown or other
  misc_feature (321)..(321): n is a, c, g, or t
  modified_base (595)..(595): a, c, t, g, unknown or other
  misc_feature (595)..(595): n is a, c, g, or t
tcagcgtagactagcacgaccggtgctcgatttagatcgtctgtgttgggtttggggacaaaaaaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggagcaccttnagcgactatagttcaagttgggtgcgacgggcctcgtggacaggtccttgagtggatgggaaggntcgtcctatcgtgacacaccaaactcgcacagaacgtccgagggcacgactcaaccgataacccgacggaaacctaaaagttaaaccgaacactaagttaaacgtacgtaggacgacgtagaacacgtacctgtctaatcgtagaggaccgtacgggtcttacctacttctgtcggtacgtagtaagttaattaactactaactacgtcgtccttacctttaccgtaccttcccttacgtaccttcgtcgggcctacgtaccggacccggtccnccgtcctcccg

SEQ ID NO: 103954 - DNA, 559 bp, Homo sapiens
  misc_feature: GYAE6OF01ALL2I.17.34.D01.1.454.CMB.1.raw
  modified_base (283)..(283): a, c, t, g, unknown or other
  misc_feature (283)..(283): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggaggcaccttcagcgactactagtttcaattgggtncgacggggcctctggactaaggccttggagtggatagggagatcgtcctagtcgttgacacacaactcgcacagaacttcgaggcagactcaacgataaccgcggacaaagttaacgaacacagttaatctaggacgactgaacngacctgtcatcngagacgacggcttactacttctgtggcgtacgagttaatactataacncttancgtttcctttacaccttcccttgaccttggtacgggtcctagtaccggacccggtcaccggttccc

SEQ ID NO: 103955 - DNA, 530 bp, Homo sapiens
  misc_feature: GYAE6OF01B9TJF.17.34.D01.1.454.CMB.1.raw
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacggcctcgtggacaaggccttggagtggatgggaaggatcgtcctatcgttgacacaccaactacgcacagaagtcagggcagactcacatacgcgacaatacacacagtantgngctgacngctgcatcngagacncggcttctacttctgtgcgaggagtaattactataacactgtcttccttttactcccttcccttagtacttcgtcgggaccctacgtccggtaccccggtcccg

SEQ ID NO: 103956 - DNA, 727 bp, Homo sapiens
  misc_feature: GYAE6OF01DNSVP.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcacatggactggacctggaggttcctctttgtggtgcagcagctacaggtgtcccagtcccaggtccagttggtgacaagtcgtggggctggaggtgaagaccgtccgtgggtcctcgggtagagggtctcctgacaaggtcttcgtgggaggcctacttcgagacgtactattagtttacgaagttgggtcgacggaccggctacgtaggaacgaacggtccgttggagtggaagtggggaagtctcgtacctatcgttacgactaacaactaaacacgtacaagtaagaaccgttacgagggaactaacggtacctacaaacccgtaaacgtaaaccggaaccggtaaaacgtaaaaaccgttaaacgaaaccgtaaacgtaaacgttaaacgtacgttaacgggaacgtaaccgtaaggaaacctacgaccgttaggtactacgtacgtaggaacggtacgtaccggttacttaccgtacttcgtacgttagacgtaaggtaagtaacttaacgtaataaccgtataccggttcctttaaccgtttaccctacccttacccgttagaccgtttccggtacgggaacctacggttaaccggaccccggttaccg

SEQ ID NO: 103957 - DNA, 591 bp, Homo sapiens
  misc_feature: GYAE6OF01EAQWA.17.34.D01.1.454.CMB.1.raw
  modified_base (328)..(328): a, c, t, g, unknown or other
  misc_feature (328)..(328): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctctgcaaggcttcgtggaggcaccttcagcgactattagtttcaattgggtgcgacgggtcctcgtggacaaggtccttggagtggagtgggaagntcgtcctatcgtgacacaccaaacacgcacagaacgtcaggcagactcacataccgacgaactaaacgtaacgaactacagttaatcgtagacgtactacgaacacgtacctgtactagtcgtagacggacacgggtctttactacgttctggtgacgaggtaataacttaacgtaactaaccgtacttacgtccctttacttttaccctacccgttcccttgtaccttcgtacgggtacctacgtccggaccccgttacccg

SEQ ID NO: 103958 - DNA, 676 bp, Homo sapiens
  misc_feature: GYAE6OF01CGLUO.17.34.D01.1.454.CMB.1.raw
  modified_base (133)..(133): a, c, t, g, unknown or other
  misc_feature (133)..(133): n is a, c, g, or t
  modified_base (180)..(180): a, c, t, g, unknown or other
  misc_feature (180)..(180): n is a, c, g, or t
  modified_base (463)..(463): a, c, t, g, unknown or other
  misc_feature (463)..(463): n is a, c, g, or t
tcagcgtagactagcacgaccggtgctcgatttagatcgtctgtgttgggttgggacaaaacaaccagattcctcctctaaagaagcccctgggagcacagctcatcaccatggactggacctggagttcctntttgtggtggcagcagctacaggtgtccagtcccaggtccagttggngcaatcgtgggctggaggtgaagacgcgtgggtcctcgggtggtagggtctccgtaggcgtaaggtcttcgtgggacggtcctaccttgacgtcgacttagttagtttcgaacgttggggtgaccggtacggggcctcgtcggacgaaggtccgttggaggtggagtgggacggactcgtcctagtcgtacgaacaccaactaaactcgccgaacacggtaagtccgaggacacgactaccacactaacccggagaaactaaataacgaacacgtaacttaancgtaggacgtatacgaacgaactccgttagactatacgtacggacgtaaccgtacggtccttcgtacgtacgtgggtatccggtaaggtaactaacgttaacgtaactacgtacctacgttaccctttaccgttttacctacccgttaccgttatacccgttcggtaccggtacgttacggtaccggtaacccccggttcgacccgttcccgg

SEQ ID NO: 103959 - DNA, 554 bp, Homo sapiens
  misc_feature: GYAE6OF01ARTDX.17.34.D01.1.454.CMB.1.raw
  modified_base (510)..(510): a, c, t, g, unknown or other
  misc_feature (510)..(510): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgacttatagtttcaattgggtgcgacgggcctctggacaaggcctttggagtggatgggaaggatcgtccctatcgttgacacaccaaactacgcacagaagttccagggcagactcaccataaccgcggaacaaataacgaacacagttaatctaggacgactagaacacgcctgtcatctagacggacacggcttctacttctgtgcgaggagtaattactataacactagtccttacttttaccnccttcccttgtacttcgtacgggtcccacgtcggtaccccgtcg

SEQ ID NO: 103960 - DNA, 564 bp, Homo sapiens
  misc_feature: GYAE6OF01E35PI.17.34.D01.1.454.CMB.1.raw
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttnacacaccaaactacgcacagaacgttcgagggcagactcaccataaccgcggaacaaattaacgaacaactagttaatcgtaggagctagaacagcctgtactatcgtgacggacgacgggtcttctacttctgtgcgaggtagtaattactataacactcgtccttaccttttacctcccttcccttgtacttcgtcgggaccacgtccggtaccccggtaccg

SEQ ID NO: 103961 - DNA, 840 bp, Homo sapiens
  misc_feature: GYAE6OF01C7H12.17.34.D01.1.454.CMB.1.raw
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttggtggtggcagcagctacaggtgtccagtcccaggtcctagttggtgcaatcgtggggctggaggtgaagacgccgtgggtcctcgggtggagggtcctccgtgacaaggtcttcgtggacggctaccgttcgacgcgtaacgttagttacgtttaccgtaaaggtttcggggtacgtaccgggaaccgggtcccttacgtacggggtaaccgtaaaacggggtccccgttttagggaagggttacgggtaaggttaagggggggaaacggtacggtttcccggttaccccgtttacggttaacccggtttacgggaaaaccccttaaccgaaaacccgaaaaccgttacccggaacctaaaccgtaaacggtaaaccggtttacccgaaacgggggtaaccaacggtaaccctaccgaaacccgtaaaccggtaaacccggaccggtaaaacgttaaaaaccgttaaccgaaaaccgaacgttaaacgttaacgtacgttaacggagtacgtaacgaaacgtacgtacctacgtaccagttacgtaggaacggtaccgacggttctttacgttacgttcgtaggtacgtacgtaggtataacttaacgtaactacctagttccgtacttacccttttactacccttccgttacgtacttccggtacggaccctacgtcccggtaacccggtacccg

SEQ ID NO: 103962 - DNA, 675 bp, Homo sapiens
  misc_feature: GYAE6OF01AQ28L.17.34.D01.1.454.CMB.1.raw
  modified_base (335)..(335): a, c, t, g, unknown or other
  misc_feature (335)..(335): n is a, c, g, or t
  modified_base (439)..(439): a, c, t, g, unknown or other
  misc_feature (439)..(439): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggcttcgtggaggcaccttcagcgtactattagtttcaagttgggtgcggacgggcctcgtaggacaaggtccttggagtggagtgggaagtntcgtcctagtcgtagacacaaccaactcgcacagactccgaggcagactcaaccagtaacccgacggaactaaacgttaaccgaactaacgtaacgttaaacgngggaacgtacgtaacgaaacgtacgtaccgttagtacctacgtacgtacggaacggtaccgtaccgggtctttacgttaaccgttcgtagggtacggaccggtaaggtaagttaacttaacgtaactaaccgtaccgttacgtacccttttacccttttaccgaccctttcccgttacggtaccgtttacggtcgggtaccctacggttaccccggtaaccccggtctaaccccgg

SEQ ID NO: 103963 - DNA, 600 bp, Homo sapiens
  misc_feature: GYAE6OF01AC1JH.17.34.D01.1.454.CMB.1.raw
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgaggtctctgcaggcttccggagcaccttcagcgactatagtttcaagttgggngcgacgggcctcgtggacaggtccttggagtggatgggaagntcgtcctatcgtagacacaccaactcgacacagaagtccgaggcagactcaccaagtaaccgcgaactaagtaacgaacactagttaactcgtaggagctagaacagctacgtcatcgtagacggacgacgggttcttctacttcgtgtacgacgtaaggtaattaacttaactaactaaccgtacgttgttaccctttccttttaaccacccgttccctttagtaccgtttcggtaccgggtaccttacggtacccggttaccccgtccgtacccg

SEQ ID NO: 103964 - DNA, 671 bp, Homo sapiens
  misc_feature: GYAE6OF01DSTNZ.17.34.D01.1.454.CMB.1.raw
  modified_base (345)..(345): a, c, t, g, unknown or other
  misc_feature (345)..(345): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcgggtgagggtctcctgcaaggcttctggacggctacccttcagcgaactagtagttttcaagtttggggtgccggacgggtcctcgtggacctaaggtccttggagttgggagtggggaagntcgtccctatcgttgacacaaccaaactacgacacagaacgttccgaggacacgactaccaacaacgtaaccgcgaactaaaacttaacgaacgtaacaagttaaactacgttaggaagacgtagaaacgtacgacctagtctaactcgtacggaacgaccgtacgggtccttactacgttacgtgtacgtcggtaaggtaacgttaaacttaacgtaactaaacctacttcgtacccgtttacctttttaacccgtaccctttccccgtttacgtaccgttccgttacgggtaccctacggttacccggtaaccccgttacccgg

SEQ ID NO: 103965 - DNA, 572 bp, Homo sapiens
  misc_feature: GYAE6OF01DU4IN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagtttgggtgcgacgggctcgtggacaaggccttgagtggagtgggagatcgtccctatcgttgacacaccaaactacgcacagtaagttctagggcagactcaaccataaccgcggaacaaattaacgaacaacaagttaatacgtaggacgctagaacacgcctgtcatcgtagaggacgcggcttctacttctgtgcgaggtagtaattactataactatacgtccttaccttttactcccttacccttgtacctttccgtacgggaccctacgtccggtaaccccggtacccg

SEQ ID NO: 103966 - DNA, 727 bp, Homo sapiens
  misc_feature: GYAE6OF01CFZTG.17.34.D01.1.454.CMB.1.raw
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagacgcctgggtcctcggtgagggtctccgtggcaaggtcttcgtgggaggcctaaccttcgagcgtaacttattagtttcaagttgggtgcggacggctccgtaggacgaaggtccgttgaggttggagtcggggaagtagtcgtccctaatcggttcgaaccacgaaccaaaacgtacgacgaacagaaacgttcgaagggacaagtacctacgaacctaataacccggaggaaacctaaaacgtaaccgaaacaacgtaaagtaacttacgtacggaacgtacgtaacgaacgacgtaccgttagtacgtaacgtcgtaggaaccgggtacgtacgggttacctttacgttacgtttaccgtaggtacggtacggtaagttaaggttaacttacgtaataaacgttacttaccggttcctttaacccgtttttaacctaccctttacccgttcttaacccggttccggttaccggtaccctacgttacccgggtaacccccgttcgtaccccgtttaccccg

SEQ ID NO: 103967 - DNA, 681 bp, Homo sapiens
  misc_feature: GYAE6OF01ENJN9.17.34.D01.1.454.CMB.1.raw
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (615)..(615): a, c, t, g, unknown or other
  misc_feature (615)..(615): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctctgcaggcttcgtggagcaccttnagcgatatagtttcaagttgggtncgacggtcctgtggacaaggtccgttggaggtggagttaggggaagtacgtccgtccctagttcgttagaccaacaacccaaacgtacgacacgagtaacgttccgagggcaacgactaccaaccgtaactaaccggacggaaacctaaaagttaaaccgaaacaacctaagttaactacgtaggacgtacgttagaaacctaggtacccttacgtacgtacgttcgtacggacggaccgtaacgggttccttaccttaccgttacggttagtcgtacggaggtaattaacgttaactaacttaacgtactacgttacctttacccttttacncccctttacccttacgttaccgttacgtaccgggtacctacggttaccggtaacccccgttacccg

SEQ ID NO: 103968 - DNA, 564 bp, Homo sapiens
  misc_feature: GYAE6OF01ELWXS.17.34.D01.1.454.CMB.1.raw
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
  modified_base (519)..(519): a, c, t, g, unknown or other
  misc_feature (519)..(519): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncggacgggcctcgtggacaaggccttggagtggatgggaagntcgtccctatcgttgaccacaccaaactacgcacacgaacgttccagggcagactaccacactaaccgcggaacaaattaacgaacaactaagttaactacgtggagactagaacagtccgtcgtcatctgacggacacggtcttcttactctgtgcgaggtagtaacttactatacatcgtcttcctttacncccttcccttgtaccttcgtcggccactccggtaccccggtaccg

SEQ ID NO: 103969 - DNA, 613 bp, Homo sapiens
  misc_feature: GYAE6OF01B0EUP.17.34.D01.1.454.CMB.1.raw
  modified_base (352)..(352): a, c, t, g, unknown or other
  misc_feature (352)..(352): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttagagtggagtgggaagagtcgcctatcgtgacacaccaatacgnacagaagttcagggcagactcaccagtaaccgacgacaaattaacgaacaacgaagttaatactagagatacgaacacgcctagtcatcgtaggacggacgtacgggtcttactacgttctggtgacggaggtaagttaacgttaacttaattaaccgtaacgttacgtcctttacccgtttttaaccctacccttaccccgtttacgtaccgtttaccgtcgggtacctaaccgttaccgggtaacccccgttaacccgg

SEQ ID NO: 103970 - DNA, 624 bp, Homo sapiens
  misc_feature: GYAE6OF01CWD28.17.34.D01.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctcgtttgtggtcggcagcagctacaggtgtccagtcccaggtccagttggtgcaatcgtggggctggaggtgaagacgcctgggtcctcggtgaggggtctccgtgccaaggcttcgnggaggcaccttnagcgactatagttcaagttgggtgcgacgggcctcgtggacaaggtccttgagtggagtgggaagatcgtcctatcgttgacacaaccaactcgcacagacgtcgaggcagactcaccactaaccgacgaactaaataacgaactaactaagtaactcgtagagactagaacacgcctgtactacgtcgtagacggacgacgggtccttacgttacttcgtgtcgtacgtaggtacgttaattactaacttaaaccgtactacgttacctttacccgttttacctaccctttacccgttcgtaccgtttcggtacgggtacctacgtacccgggtaacccccggtcgtaccccggttccc

SEQ ID NO: 103971 - DNA, 841 bp, Homo sapiens
  misc_feature: GYAE6OF01AO5XZ.17.34.D01.1.454.CMB.1.raw
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccgaggtccaggttggtgacaatcgtggggctggaggtgaagaccgccgtgggtcctggtgagggtcctccgtgcgaaggtcttcgnggacgcctaccttcgagcgacttagttacgttcaagttgggtgccggacgggtccctcgtaggaaccgaacggtccgttaggacggtggaggtaggggaacggtactccggtacccctagttccgttacgaacctaaccgaaccctaaaccgtaccgacctaaaccgtaagggtaaaccggttcccgaacggggtaccaaccggtaaccttacccgaaacccgtaaacgtaaacccgggaccggtaaaacctaaaaaccgtttaaaccgaaccctaacgttaaacggtttaaacgtaccggttacggaaacgtaccgttaacgaaacccgacgtacccgttacggttacctaacgttcgtaacgggaacggtaacccggttaccgggttactttccgttaaccgtttcgttacgggtacggtacggtaacggttaacgttaacttaaccgtaaagttaaccctaccggtttccgttacccgtttttaacccttttacccgaccccgttttacccgttacgtttacccgtttccggggtaccgggttaccctaccggttccccgggtaaacccccggttccccg

SEQ ID NO: 103972 - DNA, 719 bp, Homo sapiens
  misc_feature: GYAE6OF01BHOFH.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaaggtcttcgtgggacggcctaccgttcgaggccgtaacttagttacgtttctaagtttggggtcgccggaccgggtccttcgtagggacgaagggtccttaggacggtgggagtaggggaaggtacgtcgtccctagttcgttacgacacgaaccaaacgtacgacaacgacgtaacgtaccgaggacacgacctaccaaccaacgtaacccggacgaaactaaaacgttaaccgaaactaacgtaacgttaacgtaccgtagggaacgtacgtaacgaaaccgtacggtaccttcggtacctaacgttcgtaaggaaccgggtaaccgtaccgggtctttacgtacgttcgtggtagacggtagtagttaacttacgtaactaacctacgttcgtcctttacctttacccaccctttccgttacgttaccgttccggtccgggtaccctacgggttacccggtccccggttacccg

SEQ ID NO: 103973 - DNA, 570 bp, Homo sapiens
  misc_feature: GYAE6OF01E380L.17.34.D01.1.454.CMB.1.raw
tcagcgtagactagcacgaccggtgctcgatttagatcgtctgtgttgggtttgggcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaattgggtgcggacgggcctctggacaaggccttgagtggatgggaagatcgtcctatcgtgacacaccaactacgcacagacgttccagggcagactcaccaataaccgcggaacaaacttaacgaacacaagttaactctaggagactagaacacgcctgtcatctagacggacacgggtcttctacttctgtgcgaggtataacttactataactactgtccttccttttaccacccttcccgttcgtacctttccgtcggggtaccctagtcccggtaacccccggtcgtaccccg

SEQ ID NO: 103974 - DNA, 551 bp, Homo sapiens
  misc_feature: GYAE6OF01ACVRP.17.34.D01.1.454.CMB.1.raw
  modified_base (318)..(318): a, c, t, g, unknown or other
  misc_feature (318)..(318): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggagntcgtcctatcgtgacacaccaactcgcacagaagtccaggcagactcacataccgcgacaaattacgaacacagtatctgagctagaacagcctgtcatctagacggacgacggtcttctacttcgtgtcgcgaggtagttaattactatacactacgtcttaccttttaccacccttcccttcgtaccttcgtcgggtacctacgtaccggtaccccggtcgtcccgttccc

SEQ ID NO: 103975 - DNA, 906 bp, Homo sapiens
  misc_feature: GYAE6OF01DBIK0.17.34.D01.1.454.CMB.1.raw
tcagcgtagactagcacgaccggtgctcgatttagatcgtctgtgttgggtttgggatcaacaaaacaaccagattcctcctctaaagaacgcccctgggagcacagctcatcacatggactggacctggagttcctctttggtggtgcagcagctacaggtgtccagtcccaggtcctaggttggtgcaatcgtgggctggaggtagaagcgccgtgggtcctcgggtgacgggttctcgtgaccgaaggtcttcgtggacggcctaaccttcgaagtccgtaattaagtacgttttacgaaggtttcggggagccggtaaccgggtccttacggtaacgggaaaccgtaaacggggtcccgttagggtaaaggtgggtaaacggttagggggaaacgggtactttcccggttaaccccgtttaaggttccggtttaacgaaacctaacccgaaaaccttaaaaccgtaccggaactaaaccgtaacggtaaaaccggttcccggaaaaggggtccaaacgtaacccgtaccgaaacccgttaaacgtaaaccccgggaacgtaaaacgtaaaacgttaacccgaaaacctaacgtaaacgtttaacgtacgtacggtaaacgtaccgttaaacggaaacctaaccggtaccgttaacgtaccgtaagttacccggttaaggaaccgggaacggtaccggtttacctttaacccgtttcctttaacgttccggttaagggaaccgtaagggtaaaccgttaacttaaaaccgtacctaaaacctaccgtttacgttaaccccttttaacctttttaaccccgtcccctttaccccgtacgttttaaccggttccgttaaccggggtcccttaaacgggtacccccgggttaacccgttaaccccg

SEQ ID NO: 103976 - DNA, 739 bp, Homo sapiens
  misc_feature: GYAE6OF01CKHRF.17.34.D01.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
tcagcgtagactagcacgaccggtgctcgatttagatcgtctgtgttgggtttggggatcaacaaaacaaccagattcctcctactaaaagaacgccccctgggagcacagctcatcaccatggactggacctggaggttcctctttggtggtggcagcagctacgaggtgtccagtcccaggtccaggttggtgcaagtcgtgggctggaggtgaagcgccgtgggtcctggngtaggtctccgtgcgaggtcttgnggagctacctnagcgatagtagttacagttggtgcgacggtcctcgaggacaggtccttggacgtggagtagggaagtctccgtacctagtcgtagaaccaactaaccaaacgtcgccaacgagtaacgttccgaagggtcaacgactaccgaaccgaacgtaacccggacggtaactaaaacgttaaaccgaaacctacgtaaacgttaagtcgttacggaacgtacgtaacgaaccgacgtcccgtacgttacacgttacgtacgggaacggtaacccggacgggtttacctttaaccgttccgtttaccgtggtacggtacggtaaggtacgtttaaacttacgttaaacgtaaccgtaccgttaccgtttaccctttaaccccgtttttaccctaccccgtttaccccgttacgtttacccggttacccggtacgggtacccttaacggttccccgggtacccccgtttacccccgg

SEQ ID NO: 103977 - DNA, 698 bp, Homo sapiens
  misc_feature: GYAE6OF01EELN1.17.34.D01.1.454.CMB.1.raw
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggtcttcgtggaggcaccttcagcgactatagtttcaagttgggtgcgacgggcctgtggacaggtcctgngtggagtgggaagntcgtcctgtcgtanacacgaacaactacncacagacgtcgaggacagactcactaacgaccgacggaaactaaactaaccgaactaactaagttaactcgaggagtactacggaacacgtcctagtacatcgaggacggacgacgggttcttacgtaacgtttcgtacgtacggtacgggtaacgttaacgtttaacgttaaccgttaaacttaacccgtaacgttttccggtaacccttttttacccccgttttaaacctttacccccgtttaccccgttttacggaacccgttttccccggggtacgggttcccccttaaacggggttaacccccggggtaaacccccggtttcccgtacccccgggtttacccc

SEQ ID NO: 103978 - DNA, 654 bp, Homo sapiens
  misc_feature: GYAE6OF01CZ7PW.17.34.D01.1.454.CMB.1.raw
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (443)..(443): a, c, t, g, unknown or other
  misc_feature (443)..(443): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcgggtggacgggtctcctgcaaggcttgtggagctctcagcgactatgttcaagttgggtgcgacgggtcctcgtggaacgaaggtccttaggnggtggagtaggggaagntccgtccttagtcgttacgactaccaacctaaactacgacaacaagactcgaaggcagactcaaccactaccggacgaacaactaacgacactagttaatacgaggtanactagaacacgtactgtacactacgtacgacggaccgtaacgggttctttaccgttactttacgtggtacgacggtaagggttaattaacttaacgtaactaaaccgtacttcgtacccttttacccttttaaccctcccctttaccgtttacgttaccctttcgggtaccgggtacccttaacggtcccgggtaacccccgttaccccgg

SEQ ID NO: 103979 - DNA, 754 bp, Homo sapiens
  misc_feature: GYAE6OF01CTWX6.17.34.D01.1.454.CMB.1.raw
  modified_base (291)..(291): a, c, t, g, unknown or other
  misc_feature (291)..(291): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggtcttcgtggacttcaccgtttacctcctatagtactctaacgtgggtnccgccaggccgtcgtacggaccaacggccgtggacggtggagtggggagtcggggacctaaacccctaagaccgttggtacggtaccaacgtacgttgtaccttaccacccgtaacgttcccgtaccgggacaacgtaacccttaccgaacgtcgaacccgaacggtaaccttaccctaaccctaaacttaaaacccaccgaacgtacccctaaagtacgttacgggaagttacggaacgggtacgtcccgtagaactaacgttcgtacggaaccgtaccgtaaccggtcccgttacttacgttaacgttcggtacgacggtacgtaacgtaccccgtaacggtaccgttacccgggtacggtacccgtacccgttaaccgggccgtaccgggtcccggtttacccggtttacggtacccggtttcggggtaaccggggttcccggtaaacggggtcccccgg

SEQ ID NO: 103980 - DNA, 628 bp, Homo sapiens
  misc_feature: GYAE6OF01CGPCC.17.34.D01.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcgggtgagggtctccgtgcaaggtcttcgtggaggctaccttcagcgtactatagttcaagttggtgcgacgggcctgtggacaaggcttgagtggatgggaagntcgtcctagtcgtgacacacaaactcgacanagagtccaggcagactcacataacgcgaactaaagtaccgaanactaagttancgtagagactagaacngctagtcagtccgtagacggtaacgacgggtcttacgtaacttcgtaggtacggtacggtaaggtaaacgttaactactaaactaaccgtacttacggttacccttttaccgttttaccctaccgtttaccctttacgtaccgtttcggtaccgggtacctaaccggttacccgggaacccccgttcgtcccgtttaccccg

SEQ ID NO: 103981 - DNA, 792 bp, Homo sapiens
  misc_feature: GYAE6OF01DDDDX.17.34.D01.1.454.CMB.1.raw
  modified_base (366)..(366): a, c, t, g, unknown or other
  misc_feature (366)..(366): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggacggctaccttgagcgtaacttatagtttacaaggttgggtgcggaccggtcctctgggaaccaaggtccttaggaggtggaaggtagggaagtacgtccgtacctagtcgttanaaccacaaaccaactaccgacaacgtaagtaacgttccgaaagggtccaaggtaacctaccgaaccgtaacgtaaacccggtaaccggaaactaaaacgttaaaccgaacctaaacgtaacgttaaacgtcgtaacgggaacgtacgtaaccgtaaccgtaacggtaccgttacgtaaccgtacgttacgtaacgggtaaccggtaaccggtacccggggttaccttttacccgtttaaccgtttaccgttaggttaccggtacccggtaaagggttaacgttaaacgttttaaacctaaacgttaaaccgtaccgtttaaccgttacccgttttaaccccttttaacctccccgtttaccccgtttacgtacccgtttacggtaccggtacccgtaggttaccccggtaacccgggtttaccccg

SEQ ID NO: 103982 - DNA, 900 bp, Homo sapiens
  misc_feature: GYAE6OF01B4XD4.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcgggtgacgggtctccgtgccaagggtctttcgtgggacggtcctaaccgttcgacgtacggtaacttattaggtttaccaaaggtttggggtacgtaccggtaccggggtcccttcgtagggaaaccgtaacgggtcccgtttaggaacggtttaggaacggttaggggaaacgggtaccttacccgggttacccccttaaaggtttcccgggtttacgaaccgaaacccgtaaaccctaaaacccgttacgaccaaacgtaacggtaacgtttacccgaacgggacaacggtaacttacccaaaccgaaacgttaaccccggacggaaaccgtaaaaccgttaaaccgtaaccgtaaactaacgttaacgtacgttacggaacgtaaccgtaacggaaacctaccggtaacccgttagttaacccagttaccgtacggtacgggtaaacccgtacggggttacctttacgttaccgtttacgttaggtacggtaacggtaacggttaacgttaaacgttaaacgttaaacgttaaaccgttaacccgttacgttacccgttttaacccctttttaaccccgtaccccttttaccccgttaacccggtttacccgttttaccggtaccggggttaacccctacgggttaaccccgggttacccccggtttaaccccg

SEQ ID NO: 103983 - DNA, 772 bp, Homo sapiens
  misc_feature: GYAE6OF01DRH3G.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtgggctggaggtgaagacgcgtgggtcctggtgaggtctctgcgaaggtcttcgtggacgctaccttgacgacgacttagttagttttacgaagtttggggtcgaccggtaccgggccttcgtacgggaacgtaacgggtccgttaggtacggttgggaaggttaggggaaacggtcgttacccggtacccgttaagttccggtttaccgaaaccgtaacccaaaccgtaaaaccgtaaccgaccgtaaacgtaaacgggtaaacgtttacccggaagggtaccaacggtaaccctaacccgtaacccgaaaccgtaaaacccggaccggtaaaactaaaaacggttaaaccgaaaccgtaaccgttaaagtttaactaccggttaaggaacgtacgttacggaaactaccggtcttacgactacgttcgtacggaacggtaccgtacgggttccttaacttaccgttcgtggtacgacgtaaggtactaacttactataactctacgtccctttacgtttactcccttaccgttacgttaccgttcggtcgtacctacgtccccggtaccccgtacg

SEQ ID NO: 103984 - DNA, 922 bp, Homo sapiens
  misc_feature: GYAE6OF01DNYJV.17.34.D01.1.454.CMB.1.raw
tcagcgtagactagcacgaccggtgctcgatttagatcgtctgtgttgggttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtggacgggtcctccgtgacgaaggtccttcgtgggacggtccaccgtttcacggtccgtaacctttagttaacgttttaccgaaagtttgggggtcggaccggtaccgggggtcccttaacggtcgggtaacccgtaaacggggtccccgttttagggaagggttacggggaaggttacggggggtaaaacggtaccggttcccgggttttaccccctaaaggtttccggttaacggaaaccccgtaaccaaaccccgtaaaacttacccggacctaaaccgaacggtaaacgggtttcccgaagggggaacctaacggaccctacctaaacccgtaacggtaaaccccggacggtaaaaccgtaaaacgttaaaccggaaactaaacccgtaagtttaaacgtacccgttagggaacgtacctaaaggaacccctaacgtcccgttaacggttaccaacggttaccgttagggaaccggtaccggtacggggttaccctttacgtttaacctttccggttaacggttcgggtaacccggtaaaggggttaactttaacgtttaaaaccgttaacctttaaaccgacctttaccggttaccctttttaacccgtttttaccacccccgtttccgttacgttacccgtttcggtacggggtaccccttaagggttccccggtaaccccggttaacccg

SEQ ID NO: 103985 - DNA, 553 bp, Homo sapiens
  misc_feature: GYAE6OF01D83H9.17.34.D01.1.454.CMB.1.raw
  modified_base (348)..(348): a, c, t, g, unknown or other
  misc_feature (348)..(348): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtgcgacgggcctctggacaaggccttgagtggagtggggaaggatcgtcctatcgttgacacacaactacncacagaagttcaggcagactcaaccataaccgcggaacaaataacgaacactaagttaactctggagactagaacagcctgtcatcgtgagacacggcttctacttctgtgacgtagagttaatactatactatcgtacttaccttttactaccttccttcgtaccttcgtacgggtccacgtacggaccccgtcgtacccgtcc

SEQ ID NO: 103986 - DNA, 761 bp, Homo sapiens
  misc_feature: GYAE6OF01A2QWR.17.34.D01.1.454.CMB.1.raw
  modified_base (303)..(303): a, c, t, g, unknown or other
  misc_feature (303)..(303): n is a, c, g, or t
tcagcgtagactagcacgaccggtgctcgatttagatcgtctgtgttgggtttgggggatcacaaaccaaccagattcctctctaaagaagccctgggagcgaccagctcatcaccagtgacctggacctggacgttccgtctttgtggtaggcacgcagctacaggtgtccagtcccaggtacccagttggtcgcaactcctggggctgacggtgaacgacgccgtgggtcctcggtgacggtcctcctgcgtaaggccttcgtggaggcacgtcagcgactatagtttctaagttgggtancggacgggcctacgtacggacgtaaggccgttacggaagtcggtacgtaggggaacgtacgtaccgtacccttaagtccgtttggaacctaacgtaaccgaaaaccggttaccggaccctaaacgtaacggaaacggtttccgaacggggtactaacggtaaccgtaccgaaccgtaaacgtaacccggcgggaaaccttaaaacgtttaaaccgtaaactaaaccgtaacgtttaaacctaccgttaggaacgtacgtacggaaacgtacgtaccttcgacgtactacgtagtacggtacctacgggtacttaccttacgttactaggtacgtacgtacggtaacgttaacttaccgtaattaaccgtacgttaccggtacctttaccgtttaccgtaaccttcccgtttaacgaaccgttccgtacgggtacctacgttaccggaccccgtacccg

SEQ ID NO: 103987 - DNA, 630 bp, Homo sapiens
  misc_feature: GYAE6OF01EF3GP.17.34.D01.1.454.CMB.1.raw
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgaggtctctgcaggctcgtggacggcaccttcagcgactatagtttcaagttgggtgcggacgggcctcgtaggacaaggtccttgagtggagtagggagntcgtccagtcgtcgacacacaactacgacacagaacgtcgaggacacgactacacctaacgaaccgacgaaacaaacttaaccgaaacacgtaagttaactacgtggaacgactacgaacacgtcctgtactatacgtaggacgtacgacggtctttactacgttcgtacgttgacgtaggtagttaacttaacgtaactacaccgttacgtcctttacccgtttttacctaccctttacccgttacgttaccgttccgggtacggtacccgtacggttaccccggtaccccgggttaccccg

SEQ ID NO: 103988 - DNA, 539 bp, Homo sapiens
  misc_feature: GYAE6OF01A93DK.17.34.D01.1.454.CMB.1.raw
  modified_base (322)..(322): a, c, t, g, unknown or other
  misc_feature (322)..(322): n is a, c, g, or t
  modified_base (426)..(426): a, c, t, g, unknown or other
  misc_feature (426)..(426): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtccctatcgttgacacaccaaactacgcacagaagttccagggcagactcaccataacccgcgaacaaattaacgaacacagttaatctggagctagaacncgctgtcatctggagacacgggcttctacttcgtgtgcgaggataatactatacnctgtcttccttttacncccttcccttntacttctcgggtccacgtcggaccccgtccg

SEQ ID NO: 103989 - DNA, 686 bp, Homo sapiens
  misc_feature: GYAE6OF01C9KOO.17.34.D01.1.454.CMB.1.raw
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggacggttctctttggtggtggcagcagctacaggtgtccagtcccaggtccaggttggtgcaagtcgtggggctggaggtgaagacgccgtgggtcctgggtgagggtctcctgcaggctttgnggacggctaccttnagcgaactatagtttcaagttgggtgcggacggcctcgtggaaccgaaggtccttgacggtggagtggggaaggtctacgtcctagtcgttagacaccgaaccaaactacgacaacagtaacgtccgaagggcaacggactaccaacctaacgtaacccgacggaaactaaaactaacgaaacctaactaagttaaactcgttaggaacgacgtaacgaacacgtaccgtacgtactagttacgtaggaacggaacgtaacgggtaccttaccgttacgttccgtaggttacgacgggttaagtaacggttaaattaccgtaataaaccgtacgttacgttcctttaccttttacctacccctttccctttacttccggtacggtaccctaaggtcccggtaaccccggtcgtaccccg

SEQ ID NO: 103990 - DNA, 651 bp, Homo sapiens
  misc_feature: GYAE6OF01DE3ET.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgacggggtctcctgcaaggcttctggaggcaccttcagcgactatagtttcaagttgggtgcggacggcctgtggacaggtcttgagtggagtgggagatcgtcctatcgtagacacaaccaactacgcacaagtaacgtcgaggcacgactaccaccaacgtaaccggacggaaactaaaacgttaaaccgaactaacgtaagtttaactcgtgggaacgtcgtaacgaacctacggtcccttaggtactaacttccgtaggacggtacgaccgggttcttactaacttcgtaggtcgacgtaggtaactaacttacttaataactcttacgtacccttttaccgttttaaccacccctttccgttacgtacctttcggtccggggtacctacgttaccccgggtaccccgttccgtacccgttcccc

SEQ ID NO: 103991 - DNA, 674 bp, Homo sapiens
  misc_feature: GYAE6OF01B8S8V.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggcttcgtggaggcaccttcagcgtaactatagttcaagttggtggcgacgggtcctcgtggacgaaggtccttagacggtagggagtaggggaaggatccgttaccgtagtcggttagaaccaccgaaacctaaacctacgaccgaacaagtaacgttaccgaagggcaagacctacacacgtaaacccggacgaaactaaaacttaaacgaacctaacgtaacgttaactacgtacgggacgtacgtacgaacctagacctagtacctagtacgtaggacggacgaccggtcttacgttacttcgtagtacggtacgacgtaagtaattactaactaactacgtcgtaccctttaccttttacctacccttaccttcgtaccgttccggtacggtacctacgtaccggtaaccccggtacgtcccgttacccg

SEQ ID NO: 103992 - DNA, 703 bp, Homo sapiens
  misc_feature: GYAE6OF01BATT5.17.34.D01.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
tcagcgtagactagcacgaccggtgctcgatttagatcgtctgtgttgggtttggggatcacaaaacaaccagattcctcctactaaaagaagcccctgggagcacagctcatcaccatggactggacctggaggttcctctttgtggtggcagcagctacaggtgtccagtcccaggtccagttggtgcaatcgtggggctgaggtgaagacgcctgggtcctggtgaggtctctgcaggcttcnggagccaccttcgagcgatatagttcaagttgggngcgacgggcctgnggacaaggccttaggaggtggagtaggggaagctccgtccgtatcgttgacacaaccaatacgacaagacgtacggtcgagggcagacctaccaaccgaacgtaaacccgacggtaactaaaacgttaaccgaacaacgtaacgttaataccggtaggacgtacgtaacgaacgacgtacctcggtacctagtaccgtaggacggaacccgtacggtctttaccgttaaccgttcgttacgggtacggtaccggtaaggtaaacgtttaaacgtttaaccgtaaactaaaccgttaccgttcgttaccctttttaacccttttaacccggtacccctttacccggttcttaacccggttccgggttacccgggtaccctaacggttcccccgggaacccggttaccccg

SEQ ID NO: 103993 - DNA, 801 bp, Homo sapiens
  misc_feature: GYAE6OF01E3TSJ.17.34.D01.1.454.CMB.1.raw
  modified_base (734)..(734): a, c, t, g, unknown or other
  misc_feature (734)..(734): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggggctgaggtgaagactcgtcggtcggtccgtggtgggtacggtcctcgtcgacgtacgtcttggagggacgaccttaccttacgacggaccgtaacttaacgtttacgtttaactaagggttgggtcggaccgggtaccggtccttcggtacggaacgtaaccggttcgttaggtaggtaggtagggaaggggtaacggtcgttacccgtaccttacgttcggttaacgaaccaaccaaaaccgtaaaccgtaccgaaccaacgaaacggttacccgttaccgggacggaacgacgtaacctacccgaaacctaaacccggtaaccggaaccgtaaaaacttaaaaccgttaaaaccgaaacctaacggttaaaagtttaaccgtacggtaagggacgtaccgtaaacgaacgtaccgtccgtacgtaactacgtacggtacgggaaccggaccggtaccggtcttaccgtttaccgtcgtggtacgacggtaagttaattaactaataacacttcgtcttacccttttacctttaacccncccctttcgttacgtccgtttacgggacccggtacaacgggtacccccgtaacccgccgttaccccg

SEQ ID NO: 103994 - DNA, 938 bp, Homo sapiens
  misc_feature: GYAE6OF01CM1H1.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacgccgtgggtcctcggtgagggtctccgtgcaaggtcttcgtggaggcaccttcagcgactatagtttcaagttgggtagcggacgggtcctcgtggaacaacgggtcctttaggaggttgggagtaggggaaacggtacttccggttaccccttaagtaccggtttcgaaaccgtaccgtaaacccgaaaaccgttaccggacctaaaaccgaacgggtaaacggtttcccggaaggggtacccaaacggaacccttacccgaaacccgtaaacgttaaaaccccgggccgggtaaaaaccctaaaaacgttttaaaacccgggaaaacctaaacccggtaaaaggtttttaaaacgtccccggtttaaaggggaaaccgttacccgttaaaagggaaaacccgtacgggtaacccccgtttagggttaacccaaacgtttacccggttaacgggaaaccggggtaaacccgttaacgggggtttaaccctttaccggtttaaacccccgttttggtacggtttaaccgggacccggggttaagggtttaaacgttaaaacgttttaaaccggttaaacttaaaacccgttaccgtttacgttaaccccgtttttaaccccgtttttaaacctaccccccgtttacccgttttacggtaaacccttttccgggttaccgggggtaccctaaccggttaccccgggggtaaaccccccgtttaccccgg

SEQ ID NO: 103995 - DNA, 984 bp, Homo sapiens
  misc_feature: GYAE6OF01EX810.17.34.D01.1.454.CMB.1.raw
tcagcgtagactagcacgaccggtgctcgatttagatcgtctgtgttgggtttggggatcacaaaacaaccagattcctcctctaaagaagccccctggggagcacgagctcatccaccagtcggacgtcggaccgtgggtacggtttccttcgtttggtgggtggacagcagtctacgaggtcgtccacgtcccgaggtccgtaggtttggtcgactaagtcggtggggtctggtaggtagaacgccggtccggtgggtccgtcgggtggtacgggttcctccgtggacgtaacggtcttcggtgggacgtacctaccgttcgacggaccgttaacttaagttacgtttacgtaagggtttcggggtacggaccgggtaccgggtccttacggtaacgggaaccggtaacgggtccgttagggtaacgggtacgggtaaggttaacgggggtaaacgtccgtttaccccggttaccccgttaggttaccggttaaccgaaacccgtaaacccgtaaaaccccgtaaaccggttaaccggaaccgtaaaccggtaaacgggttaaaccggttacccggaaggggtaccctaaacggttacccctaaacccgtaaacccgtaaacccggtaaaccccgggtaaccggtaaaaaccgttaaaaaaccggtttaaaacccggaaacccgttaaacggttaaacggtttaaccgttaccggggtaacggtaaaccgtacgtaaacggtaaaccgtaccggtacccgttacgtaccgtaacgttaccgggtaacgggtaaccggaccggtaccgggttacctttaccgttacgttcgtagggtacgtaaccggtaaggtaacttaacgttaaactaaccgttaactaccgttacgttaccctttttaccctttaacccgtcccctttacccgtacgttacccgtttcgggtacggtaccctaacgggttaccccggtaccccgttaccg

SEQ ID NO: 103996 - DNA, 663 bp, Homo sapiens
  misc_feature: GYAE6OF01BCGCL.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtgggctgaggtgaagacgcctgggtcctggtgagggtctccgtgcaggcttctggacggcaccttcgagcgaactattagtttacaagttgggtgcggacgggcctcgtggacaggtccgttgagtggagtgggaagctcgtcctagtcgtgacacaaccaactacgcaacgagtaacgttccgagggcagacctccaaccgaacgtaacccggacggaaactaaacgttaaccgaacaactaacgtttaactacgttacggacgacgtacgaaccacgtccgttagtacacttcgacgtacggaccgtacgggtctttacgttaccgttgttcggtacgtacggtaaggtaacgttaagttacgtaaactaaccgtacgttacgttcctttacccttttacctaccctttccgttcgttaccgttccggtacgggtaccctaacggttacccggtaccccgttacccg

SEQ ID NO: 103997 - DNA, 594 bp, Homo sapiens
  misc_feature: GYAE6OF01B1NQS.17.34.D01.1.454.CMB.1.raw
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctggtgagggtctcctgcaaggcttcgnggaggcaccttcagcgactatagtttcaagttgggtncgacggcctctggacaggccttgagtggatgggaagatcgtcctatcgttgacacaccaaatcgcacaggaacgttccgagggcagactcaaccagtaaccgcggaactaaagttaacgaactacaagttaatcgtaggaagctagaacagcctgtcatcgtggacggacgacggtctttactacttccgtggtcgaggaggtattaacgttaactaacgtaaaccacgttcgtcctttaccgtttttaccacccgttcccttgtacctttcgttcgggtaccctacgtaccgggtaacccccgttacccg

SEQ ID NO: 103998 - DNA, 714 bp, Homo sapiens
  misc_feature: GYAE6OF01EDO5F.17.34.D01.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtcctagttggtgcaatcgtgggctgaggtgaagacgcctgggtcctcggtgagggtctcctgacgaaggtcttcgnggtaggctaccgttnagcgaactattagttcaagttgggtgcggaccgggtcctcgtggactaaggtccttggaggtggagtgggaaggtctcgtcctagtcgttagaacacaacaactacgcaacgagtaacgtcgaggtacaggactacaacctaacgtaaccgacggtaaactaaacttaacgaacaactaagttaacgtacgtagaacgtacgtacgaacctagtacctacgtactactacgtacggaacggtacgtacggttaccgtttactaccgtttcgtacggttacgtacggtaacggtacgttaaacgttaacgttaaactaacgtaacgttacggttaccccttttacccgtttttaacccgtaacccccgtttaccgtttacccggttaaccgtttcgggtaccgggttaacccgtacggttaccccgggaaccccggtttaacccccgg

SEQ ID NO: 103999 - DNA, 584 bp, Homo sapiens
  misc_feature: GYAE6OF01EXEY0.17.34.D01.1.454.CMB.1.raw
  modified_base (320)..(320): a, c, t, g, unknown or other
  misc_feature (320)..(320): n is a, c, g, or t
  modified_base (415)..(415): a, c, t, g, unknown or other
  misc_feature (415)..(415): n is a, c, g, or t
  modified_base (525)..(525): a, c, t, g, unknown or other
  misc_feature (525)..(525): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacttcagcgactatagtttcaattgggtgcgacgggcctctggacaaggccttgagtggatgggagntcgtcctatcgttgacacaccaactacgcacagaagttccagggtcacgactacgacaacgtaaccgcgaacaaattaacgaactaacagttaanctggacgctagaacacgacctgtacatctagacgacgacggtcttctacttctgtcgtacgaggtacgttaagttactactaaccgacttcgtccttaccctttttaacnccctttaccttacgtacttccggtacgggtaccctacgttccggaacccccggttaccg

SEQ ID NO: 104000 - DNA, 621 bp, Homo sapiens
  misc_feature: GYAE6OF01BWHGV.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaagttgggtgcggacgggcctcgtggacaaggcctttggacgtgggagttggggaaggtatccggtcccctagtccgttggacctacaacccaaaccgtaccgcaacacggtaacgttccgagggccagacctaccaaccaacgtaacccgacggaacctaaagttaaccgaacaacctaagttaactcgtaggaacgacgtacgaacgacgtcctagtcatctagacgacgacggtcttctacttctgtgacgagtagtaattactatacactgtcctttcctttacctcccttacccgttacgtaccgttcgtccgggtacctacgtccggtaaccccggtacccg

SEQ ID NO: 104001 - DNA, 831 bp, Homo sapiens
  misc_feature: GYAE6OF01C1RBE.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcgtgggtcctcggtgagggtctcgtgcgaaggcttcgtgggacggtcctaccgttcgagtccggtaaccttagttaggttttaccaaagtttcggggtacgccggtacgggtcccttcgtgggaaccgaaaggggtcccgtttaggaaggttgggtaaggttaggggaagggtaacttccggtccccttaagttcgttacggaacctaacgaaaccaaacctaccggtacaacgaacggtaacgttacccgaagggtaccaacggtaccctaccgaacccgaaacggtaaaccccggacgggtaaacctaaaacgtttaaacccgaaactaacccgttaaagttaaacgtaccgttaagggaaccgtacgtaaacggaaacctaacgtccgtacgtactagttccgtaggacggtacgaaccgggttcctttactaccgtttgtcggtacgagggtaacggttaagttaaacgttaccgttaaagtaacccgtaacttacgttacccctttttaaccttttacccctaaccccgtttccccgttagtttaacccgtttaccgggtacccgggtaaccctttacccgggaaaccgggtttaacccccggttacccccgg

SEQ ID NO: 104002 - DNA, 768 bp, Homo sapiens
  misc_feature: GYAE6OF01A8BY2.17.34.D01.1.454.CMB.1.raw
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
tcagcgtagactagcacgaccggtgctcgatttagatcgtctgtgttgggtttgggatcacaaaacaaccagattccgtcctctaaagaagcccctgggagcacagctcatcaccatggactggacctggaggttcctctttcgtggtggcagcagctacaggtgtccagtcccaggtccagttggagcaatctggggctgacggtgaagcgccgtgggtcctcggtgagggtctccgtgctaaggcttcgngggtacggtcctaccgttcagtcgacttagtacggtttcaagttggggtncggtacggggcctgtggacctaaggccttaggacgtggactaggggaaacggtntccggtaccctagtccgtttacgacctaaccgtaacccgtaaacgttacggacctaacgtacggaaacggtttcccggaaggggtaccaacggtaaccctacgaaaccccgtaagtaaccccgggcggtaaactaaacgtttaaaccggaacctaaccgtaacggtttaactaccgttacgggaacgtcgtacggtaaccgtacgaccgttagtacctaacgtcgtacggtacggaccgtacgggtacctttccgtaaccgttcgttacggtccgtacggtaacgggtagttaacgttacgtaacgttaaccgtaccgttcgtacctttacccgtttttacaccccttttacccgttcgtaaccggttttccgtacggggtaccctacggttaccggtacccccggttaccg

SEQ ID NO: 104003 - DNA, 560 bp, Homo sapiens
  misc_feature: GYAE6OF01E40BV.17.34.D01.1.454.CMB.1.raw
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (467)..(467): a, c, t, g, unknown or other
  misc_feature (467)..(467): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtgggaggccaccttcgagcgtactattagtttcaagttgggtgccggacgggcctcgtggacaaggccttgagtggagtggggaaggntcgtcctatcgtgacacaccaactcgacacagaactccgaggcagctacacanaccgacgaacaataacgaacacagtaatctagantagaacngctntcatcngagacgacggtcttctacttcgtgtcgngaggtattaacttactataacacttcgtcctttacctttacctcccttccgttcgtacgttcgtcgggtacctacgtaccggacccgttcccg

SEQ ID NO: 104004 - DNA, 617 bp, Homo sapiens
  misc_feature: GYAE6OF01EHJ3U.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaaggcttcgtggagcaccttcagcgactatagttcaagttgggtgcggacggcctcgtggacaaggtccttgagtggagtgggaagactcgtccctagtcgttagacacaccaaactacgcaacagaacgttccgaggacagactacacactaaccgcggaactaaattaacgaacactaagtaactacgtaggacgtactagaacacgacctagtctactcgaggacgacgtacgggtcttactcttcgtcgtagacgtaaggtagttaacttacgtactaactaccgttacgtaccctttaccttttacctaccttccccttagtaccgtttcgtacgggtaccacgttaccggtaaccccgtcacccggtttcccg

SEQ ID NO: 104005 - DNA, 774 bp, Homo sapiens
  misc_feature: GYAE6OF01AV67C.17.34.D01.1.454.CMB.1.raw
  modified_base (222)..(222): a, c, t, g, unknown or other
  misc_feature (222)..(222): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagagcctggggcctnagtgaaggtctctgcaaggcttcgtggattctacgtttacctctatagtatcaacgtgggtcgcgccagggccgcgtggaccaacgacctgaggtggagtgggagtcgggaaccgtaacccctaagtacgtgggttacgtaccgtaccgtaggtcgttaccttaccgaacccctacgtccccgtaccggggaacctaacgtaaccctttaaccgaacgttaccgaaccctaaccggtaacccttacccctaaccgtaaacctaaaaccaacccgtaacgtaccccttaaaccgacgtttaacggggaacggtttacgggaacggtaccgtcccgtacggaactacgttaccgacggaacccgacccggtaaccgggtacccgttacgttaacgtttaccgttcggtacggtaccggtaaggtcccgtaccccgaacggtaccggttacccgggtccgaaccggtaccccggtaaccgggccgtaaccgggttcccggttacccgttttacggttacccgtttcccggggtcgggggtcccgtaaccgggggg

SEQ ID NO: 104006 - DNA, 617 bp, Homo sapiens
  misc_feature: GYAE6OF01CQ3G3.17.34.D01.1.454.CMB.1.raw
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
  modified_base (411)..(411): a, c, t, g, unknown or other
  misc_feature (411)..(411): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttnagcactatagtttcaattgggtgcgacgggcctctggacaggccttggagtggagtggggaagatccgtcctatcgttgaaccacaccaaactcgacacagaacgtcgaggcagacncaccataccgcgacaaataacgacactagtatactgganctagaacagcctagtcatcgtagacggacgacggtcttcgtacttcgtggtcgtcggtaaggtaagttaacttactaataaccgtacgttacgttcctttaccctttttaaccctaccccgtttaccctttacgtacccgtttacggtaccggggtccctaaccggttacccgggtaaccccccggtcggtaccccggttaccccg

SEQ ID NO: 104007 - DNA, 567 bp, Homo sapiens
  misc_feature: GYAE6OF01E4CN2.17.34.D01.1.454.CMB.1.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (557)..(557): a, c, t, g, unknown or other
  misc_feature (557)..(557): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcnggaggcaccttcagcgactatagtttcaattgggtgcgacggggcctntggacaaggccttgagtggatgggaagatcgtccctatcgttgacacaccaaactacgcacagaagttccaggcagactcaccataaaccgcggaacaaattaacgaacacaagttaatctaggagactagaacagcctagtcatctgacggacgacggtcttctacttctgtgcgaggataattactataacactgtcttaccgttttacacccttcccttgtaccttccgtcgggtccctacgtaccggaacccccgttccncccggttccc

SEQ ID NO: 104008 - DNA, 791 bp, Homo sapiens
  misc_feature: GYAE6OF01EKUJN.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcgaaggcttcgtggacggcaccttcagcgactatagtttctaagttgggtgccggacgggtcctcgtaggaccgaaggtccgttaggaggtgggtaagtaggggaaaggtacgtccggtacccttagttccgtttacgaactaccaaccaaactaccgacaacaaggtaacgttacccgagggacaagtacctccaaccgtaacgtaaacccggacggtaaacctaaaacgtttaaacccgaacgtaacgtaacgtttaaacgtacgtaggtaacgtaccgttaacgaacgtaacgtacccgtacgttacctaagttaccgtaggaacggtaccgtaaccggggtactttaccgttaaccgtttcgtcggtacgggtaccggtaagggtaacgtttaaagttaaccgttaacgttaactaccgttaccgttaccttttacccgttttttaaccctaccccgtttaccccgtttaccgttacccgtttccggtaccggggttaccctaccgggttaaccccgggtaaccccggtacccgttaccccggttacccg

SEQ ID NO: 104009 - DNA, 655 bp, Homo sapiens
  misc_feature: GYAE6OF01DFE17.17.34.D01.1.454.CMB.1.raw
  modified_base (341)..(341): a, c, t, g, unknown or other
  misc_feature (341)..(341): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtcctctggcaaggcttcgtggacggcaccttcgagcgactatagtttcaagttgggtgcggacgggcctcgtcggacgaacggtccgttgaggtggacgtgggaaggtntccgtccctatcgtcgaaccacgaaccaaactacgacaacgaagtaacgttcgacgggacaagacctacaaccaacgtaacccggacgtaactaaagttaaaccgaacaacgtaagtttaactcgttaggagacgtagaacacgtactcgtactatcgtagacggacgtacggtacttacttacgttcgtgtcgacggtacggtaagttaacttaactaactaactactacgtaccttacccttttacctacccttcccgttacgttaccgtttacgtacgggtaccgtacggtcccggtaccccggttacccg

SEQ ID NO: 104010 - DNA, 757 bp, Homo sapiens
  misc_feature: GYAE6OF01BT4NS.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcagtcgtgggctgaggtagaagaagcgtggggcctcgagtgaagtctctgcgaagtcttcgtggtattctacgtttacctccttatagtactcaacgtggtcgcgccgacggccgtcgtacggaaccaaccgaccgtaggacggtggaggtggggtagtcggggaccgtaaacccgtaacgacgttggtcgtacacgtagttcgtccttaccaccctacgtcccggtaccggactacgtaaccttaccgaacgtaccgaacccgaaccgtaacccttaccctaaccctaaacgtaaaacccaccgtaaaccgtacccttaaacgtacggtaacggtaggttacgggaacggtaccgtccgtacgaactacgttccggaacggtaacccgaccgaacccgggttccgttaacgttacgttaaccgttcgggtacgaccggtacggtacccgaccccggtaacgtacccggttacccgggagtaccccggtaccggtacccgggacgtacccgggtaccggtttcccggtttagtacccggtttcgggtccgggggtccggtaacccggggg

SEQ ID NO: 104011 - DNA, 732 bp, Homo sapiens
  misc_feature: GYAE6OF01DO4CL.17.34.D01.1.454.CMB.1.raw
  modified_base (347)..(347): a, c, t, g, unknown or other
  misc_feature (347)..(347): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttttgtggtggcagcagctacaggtgtccagtcccaggtccagttggtgcaatcgtggggctggaggtgaagacgccgtgggtcctcggtgagggtctccgtgcaaggtcttcgtgggacggcctaccttcgacgcgacttatagtttacaagtttgggtgcggacgggtcctcgtaggacaacggtccttggagtggatggggaagntccgtcctagtcgttacgactacaaccaaactacgacacaagagttccgagggcagacacaaccaagtaaccgacggaactaaacgttaaccgaaccaacgtaacgttaagtaccgtaaggtaagacgttaacggaaaccacgtacccgttagtaccaagttcgaggtacggaaccgtaccgggttcctttacgtaccgtttacgtacggttacggacggtaaggttaacggttaaactttaacgtaaacttaaaccgtaccttaccggttacccttttacccgtttttaacccttacccccgtttacccgtttacggttaacccgtttccgggtacccgggtaccgtaccggttaccccggggtaacccccggtttacccccgg

SEQ ID NO: 104012 - DNA, 574 bp, Homo sapiens
  misc_feature: GYAE6OF01E5GSU.17.34.D01.1.454.CMB.1.raw
  modified_base (295)..(295): a, c, t, g, unknown or other
  misc_feature (295)..(295): n is a, c, g, or t
  modified_base (525)..(525): a, c, t, g, unknown or other
  misc_feature (525)..(525): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctcgnggacaaggccttgagtggagtgggaagatcgtccctatcgttgacacaaccaactacgcacagaagttccgaagggcagactaccaccaacgtaaccgacggaactaaacttaaacgaaccaactaagttaatcgtaggagactagaacacgtcctgtcagtctaggagacgacggtcttactacttctgtgcgaggataatactataacactcgtcttaccttttaccncccttcccttgtaccttcgtcgggacctacgtccggaccccggtacccg

SEQ ID NO: 104013 - DNA, 740 bp, Homo sapiens
  misc_feature: GYAE6OF01CR3LT.17.34.D01.1.454.CMB.1.raw
  modified_base (315)..(315): a, c, t, g, unknown or other
  misc_feature (315)..(315): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcaatcgtggggctgaggtgaagacgctgggtcctacggtgagggtctcctgacgaaggcttcgtgggacggtctaccttcgagcggtaactagttagtttacaagttgggtgcgacggggtccttacgnggaacgaacggtcctttgggaagtggagtaggggaaggtactcgtacccctagttcggttacaccgaaccaactaaaccgtaccgacgaacaaggaacgttaccgaggtcaacgacctaccgaaccctaaagtaacccggaacggaactaaaacgttaacggaaactacgtaaacgttaactacgtacgggaaagtccgtaaggaaaccacggtacccgttaagtacctaagtacgtaacgggaacggtaacccggaacgggtttctttaacccgtttacttaccggtacgttagaccgggtaaggtaacgttaattaaccgtaataaacctacgtcgtaccttttacccttttaccgtccctttacccgtttacgttccgtacggggtaccctacggtacccggtaacccggtcctaaccccgg

SEQ ID NO: 104014 - DNA, 746 bp, Homo sapiens
  misc_feature: GYAE6OF01BOXYD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtggagggtcctccgtgcgaaggtcttcgtggacggcaccgttcagcgacttatagtttcaagttgggtgacggacgggtcctcgtggaacgtaaggtccttggaggtaggagtaggggaaggtctccgttacctagtcgttagacacaaccaaactcgacaacgaagtaacgtcgacgggactacgaacctaccaaaccgtaacgtaacccggacgtaaaccgtaaaaattaaacccggaaacgaaaccgttaaggtttaaaccgtacgttaaggggaactaaccggttaacggaaaaccgtacggtacccgttaggttaacccaaggtttacccgagggtaacgggaacccgtacgggttcccttacgttaacgttctagggtaccgaggtaaggtaattaaaccttactaaactaaccgaccgttacgttcccttttaccctttaaccaccctttccgttacgtaccctttcgggtaccgggaacccttaacggtccccgggtaaaccccgttcccg

SEQ ID NO: 104015 - DNA, 683 bp, Homo sapiens
  misc_feature: GYAE6OF01BMCW8.17.34.D01.1.454.CMB.1.raw
  modified_base (348)..(348): a, c, t, g, unknown or other
  misc_feature (348)..(348): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggcttcgtggacggctaccttcagaccgactatagtttcaagtttgggtgcgacgggcctcgtggaacgaggccttgaggtggagtgggaagctcgtcctatcgtnacacaccaactacgcaacgacgtacgtcagggccaagacctacacctaagtaaacccgacgaaactaaagttaaccgaactacgtaagttaactcgtaggaagcttagaacctacgtaccttagtactactcgtagacggaccgtacgggtcctttacgtacgttcgtggtacgtacggtaaggtaacgtttaaactaacgtaacttaaaccgtacgttacggttaccccttttacccttttaaccctccccctttacccgtttaccgttacccggtttccgggtacggggtaccctaaaccgggttcccccgggttaaacccccggttaccccg

SEQ ID NO: 104016 - DNA, 623 bp, Homo sapiens
  misc_feature: GYAE6OF01EGAQZ.17.34.D01.1.454.CMB.1.raw
  modified_base (326)..(326): a, c, t, g, unknown or other
  misc_feature (326)..(326): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctcctgcaaggcttcgtggaggcaccttcagcgactatagtttcaagttgggtgcggacgggcctcgtggacacggccttgagtggagtggggagntcgtccctagtcgtgacacaaccaactcgcagagtaacgtccaggcagactcacactaccgacgaactaaataacgaacacgtagttaactacgtagacgtcgtagaacagcctagtcactctaggacgacgacggtcttactcttcgtgtacgagtagtaacgttaacttacttaacgtacctacgttcgttacccttttaccgttttaccctacccgtttacccttcgtacccgtttccggttacgggtacccgtacgttacccgggtaacccccgttcccgtccggttaccccg

SEQ ID NO: 104017 - DNA, 925 bp, Homo sapiens
  misc_feature: GYAE6OF01BW2YI.17.34.D01.1.454.CMB.1.raw
tcagcgtagactagcacgaccggtgctcgatttagatcgtctgtgttggggtttggggatcacaaaacaaccagattcctcctctaaagaagcccctgggagcacgagctcatcaccatcggactggacctggaggttcctctttggtgtcggcagcagctacaggtgtccagtccaggtccagttggtgcaatcgtggggctgaggtgaagacgcctgggtcctggtgagggtctcctgcaaggcttctgggaggctaccttcagtcgacttaatacggttttacaaagttgggtcgaccggaaccgggcccttacgtacggaacgtaaacgggtcctttaggacggtgggtacgtgggggaaaacgtgttacccggtccccttaagttccgggtttacgaaccaaccgtaaacccctaaaaccgttaccggtacctaaaccgtaaacgggtaaaaccggttttacccgaaacggggggacctaaacggaaccccttaacccgaaaacccgtaaaccttaaaacccccgggaaccggggaaaaccttaaaaacgtttaaacccggaaaaccgtaaacccgtaaacggtttaaacttaccggttacgggaaacggtaccgttaacggtaaaccgtaacgtacccgtttacgttaccgtaacgttaccgtacggtaacgggtaacccggtaaccggggttacccttttaacccgttaaccgtttacccggttacggttaccgggtaacccggtaaagggttaacggtttaaaactttaaccgttaaagttaaaacccgtaaccgttaccgttacccgtttaccccttttttaacccgtaaccccgtttacccctttccggttaaccctttccggtaccggggtaaccctaaccggttaccccggggtaaccccccgggttaccccg

SEQ ID NO: 104018 - DNA, 708 bp, Homo sapiens
  misc_feature: GYAE6OF01EH8HZ.17.34.D01.1.454.CMB.1.raw
tcagcgtagactagcacgaccggtgctcgatttagatcgtctgtgttggggtttggggactcacaaaacaaccagattccctcctctaaaagaagcccctgggagcacagctcactcaccatggactggacctggagttctctttgtggtggcagcagctacaggtgtccagtcccaggtccaggttggtcgcaatcgtggggctggaggtgaagacgccgtgggtccgtcggtgagggtctccgtgcaggccttcgtggaggcaccttcgagcgacttagtaggtttacaacgttgggtgcgaacgggtcctcgtaggaaccaaggtccgttggaggtgggagtagggacgtgtccgtccgttagtcgttgacacgaaccgaaactacgaccaacagaacgttccgagggaccaagtactacgaaccgaagtaaacccggtcggaaactaaacgttaaaccgaacctaaccgtaaagttaacgtaccgtagggaacgacgttaagaaccgtacgaccgttagtacctacgttccgtaggaacggaccgtaacgggtctttacgtacgttcgtcgtacgtacgtaggtacgttaacgttaccgtaagtaaccgtacgttacgttaccgttaccttttaccgacccgttacccgttacgtaccgtttcggtacgggtacccgtacggttcccgggaccccggttacccg

SEQ ID NO: 104019 - DNA, 770 bp, Homo sapiens
  misc_feature: GYAE6OF01EZTET.17.34.D01.1.454.CMB.1.raw
  modified_base (244)..(244): a, c, t, g, unknown or other
  misc_feature (244)..(244): n is a, c, g, or t
tcagcgtagactagcacgaccggtgctcgatttagatcgtctgtgttgggtttggggacaaaacaaccagattcctcctactaaagaagcccctgggagcacagctcatcaccatggactggacctggaggttcctctttggtggtggcagcagctacaggtgtccagtcccaggtccagttggtgcaatcgtggggctggaggtgaagacgctgggtcctggtgaggtctctgcaagcttcgnggagcactcagcgactatagttcaagttggtgcgacggcctgtggacaaggtcttagagtggagtagggaaggtatcgtcctagtcgtagacacaaccaactacgcaactagtaagttcccgaaggtcacgtaactcaaccaacgtaaaccgtacggaactaaaacttaacggaaacacgtaacgttaagtccgtaggtactaccgttaacgaaaccgtaggtacccctagggtaacctacgttaccgtacggaaccgggttaacgaaccgggttacttttaaccgtacgtttaccggttacggtacggttaaaccggtaacggggttaaattttaacgttaaaccgtttaacgtaaacccgttactttacccgggtaccctttttaaccccgtttttaaccgtaacccccgttttcccggtaagttttaaccccggtttccggggttaaaccggggtaacccctttaacgggttaacccccggggttaaccccccggttaaaccgttaccccgggtttacccccg

SEQ ID NO: 104020 - DNA, 596 bp, Homo sapiens
  misc_feature: GYAE6OF01EI0WE.17.34.D01.1.454.CMB.1.raw
  modified_base (339)..(339): a, c, t, g, unknown or other
  misc_feature (339)..(339): n is a, c, g, or t
  modified_base (405)..(405): a, c, t, g, unknown or other
  misc_feature (405)..(405): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgacgggtctcctgcaaggcttcgtggaggcaccttcagcgaactatagtttcaagttgggtgccggacgggtcctgtggacaaggtcctttggaggtggagtggggaaggtntcgtccctagtcgtgaacaccaaccaaactcgacacgagtaacgtcaggcagactcacataaccgngaacaaataacgaacactaagtaatcgtagagactagaacacgtcctgtacatctaggacgacgtacggtcttactacttcgtgtcgcgaggtattaacgttactaactactacgtcgtcctttaccttttacctcccttacccgttgtaccgttcggtacggaccctacgtccggtaaccccggtacccg

SEQ ID NO: 104021 - DNA, 910 bp, Homo sapiens
  misc_feature: GYAE6OF01EPM64.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggacggttccttctttggtggtggcagcagctacgaggtgtccagtcccaggtccagttggtgcaagtcgtgggctggaggtagaagacgccgtggtccgtcggtgtaggtctccgtgacgtaaggtcttcgtggaggtcctaccgttcgacgtacgtaaccttaagttacgtttacgtaaggtttggggtcgaccggtaccgggtccttacggtacgggaaccgtaacggtccgttaggtacgggttagggaacggttagggggaaacggttaccgttacccggtttaccccgttaagtttccggtttaaccggaaacctaacccgtaaacccgtaaaaccgttaacggaaccaaacggtaaacggttaaaccggttacccggaacgggtacctaacgtaaccctaccgaaacccgaaaccggttaaacccggaccggtaaaaccttaaaaacgttaaccgaaaacctaaacgttaagtttaacgtaccgtaagggaacgtacgtaaacggaaccgtacgtaccgttagtaccgtacgtacgtaacggaacggtaccgtaaccgggttacctttaaccgtttacgtttccgtaggttcggtaacggtaaaccgggttaactttaaacgttaaacgttaacgtaaaccgtttaccgtttaccggtttacccctttttaacccttttaaccccgtaccccttttacccgtttaaccggttccgttaacccgggttacccggggaaccttacccgggttaaccccggtaccccggtttaccccg

SEQ ID NO: 104022 - DNA, 666 bp, Homo sapiens
  misc_feature: GYAE6OF01B41OD.17.34.D01.1.454.CMB.1.raw
  modified_base (252)..(252): a, c, t, g, unknown or other
  misc_feature (252)..(252): n is a, c, g, or t
tcagcgtagactagcacgaccggtgctcgatttagatcgtctgtgttgggtttggggatcacaaaacaaccagattccctcctctaaaagaagcccctgggagcacagctcatcaccatggactggacctggaggttcctctttgtggtggcagcagctacaggtgtccagtcccaggtccaggttggtgcaatcgtgggctgaggtgaagacgcctgggtcctcggtgagggtctcctgcaagggcttcgngggaggcctaccttcgagcgactatagtttcaagttgggtgcggacgggcctcgtggactaaggccttggaagtggagtagggaaggtctccgttaccctagttcggttacacaaccaacctaaactcgacgaacaggaacgttccgacgggtcacgtactccaaccaacgtaaccgacgaactaaacgtaacgaacaacgtaagttaacgtacgtaggtaacgcgtaagaacacgtccgtagtctacgtctaggacgacgtacgggtctttaccgtacgtttcgtagtcggacgtaacgggtaacgtaacttaacgtaacttaacctacgtacgttccgtttaccctttacctacccttccgttacgttccgttacggtccggtaccgtacgtacccgggtccccgtaccccg

SEQ ID NO: 104023 - DNA, 656 bp, Homo sapiens
  misc_feature: GYAE6OF01B57M1.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgaggtctcctgcaaggcttctggaggcaccttcagcgatatagtttcaattgggtgcgacgggcctcgtggactaaggcctttggagtggatggggaagatcgtccctatcgttgactacacaaactcgcacagaagttccgaggcagactcgacctagtaacccgcggtaacaaacttaaccgaacaacgtaacgttaatctaggagacgtacgaacgacgtacccttgtacctaagtccgtaggaacggaccgtaccgggtcttcgttaaccgtttccgttggtcgtacggtaggtaagttaacgttaacttaacgtaaaccacgttacgttccgttacccttttttaacctacccctttaccccgtttacgttacccgtttccgtacggggttaccctaacggtacccgggtaacccccggttacccgg

SEQ ID NO: 104024 - DNA, 612 bp, Homo sapiens
  misc_feature: GYAE6OF01B1RO6.17.34.D01.1.454.CMB.1.raw
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
tcagcgtagactagcacgaccggtgctcgatttagatcgtctgtgttgggtttgggatcacaaaacaaccagattcctcctctaaagaagcccctgggagcacagctcatcaccagtggactggacctggaggttcctctttgtggtggcagcagctacgaggtgtcccagtcccgaggtccagttggtgcaatcgtgggctgaggtgaagcgcgtggtcctcggtgaggtctcgtgcgagtctgtggacgcaccttgagcgtactagtgtttacaagttgggtagcggtacggtcctgtcggaaccgaggtcctaggagtggagtggggaagtactcgtccgtatcggttacaactaccgaactaaacgacgtacaacaaggtaacgttcgacggctagactaccgaacacgtaacgacgaacgaaacgttaaccaanacgtaagtaactctaggtatacctaancgctanactancgagacgtnacggtcttaccgtattcgagtcgtagaggtaactacgtactaattacctcgagttcccttacctttacgaccccttccttagccgttaccgtcgggaccttacgacccgtaccccgtcgtaccccg

SEQ ID NO: 104025 - DNA, 626 bp, Homo sapiens
  misc_feature: GYAE6OF01BH7I2.17.34.D01.1.454.CMB.1.raw
  modified_base (260)..(260): a, c, t, g, unknown or other
  misc_feature (260)..(260): n is a, c, g, or t
  modified_base (354)..(354): a, c, t, g, unknown or other
  misc_feature (354)..(354): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttctggaggcaccttnagcgactatagttcaagttgggtgcggacggcctcgtggacaaggtccttggaggtggagtgggaaggagtcgtcctatcgtgacacaccaacncgacacagacgtcaggcagacacaccaataccgacgaactaaacgttaacgaactaacgtaagttaactcgtagggactctaacggaaccagcctagtactatcgtacggaacggacgtaccgggtacttacgttacgttgtcgtacggtacgtaacgggtattaacttactaacgtaccacgttactcccttttacctttaaccgccctttacccgttcgtaccctttccgggtacggtaccctacgttcccgggtaaacccccgttcccg

SEQ ID NO: 104026 - DNA, 677 bp, Homo sapiens
  misc_feature: GYAE6OF01EWLLJ.17.34.D01.1.454.CMB.1.raw
  modified_base (191)..(191): a, c, t, g, unknown or other
  misc_feature (191)..(191): n is a, c, g, or t
  modified_base (245)..(245): a, c, t, g, unknown or other
  misc_feature (245)..(245): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgngggctgaggtgaagacgccgtgggtcctgggtgagggtctcctgcaggcttcgnggagcaccttcagcgtactatacgttcaagttgggtcgcggacggcctcgtaggaacgaacggtcttggaggtggagtagggaggacttccgtccgttagtcgttacgaaccaaccaaccgtaaactaccgacaacgacgtaacgtccgagggcaacgacctaccaccgtaacgtaacccggacgtaaaactaaacgttaaacgaacctaacgtaacgtttaacgtacgtaggtacgacgtaacgaacgacgtaccctgtacagtacgtaggacgtacggtacggtcctttctacgttgtcggagtacggtaggtaacgttaacgttaactaacgtaactaccgttcgttaccttttaccgttttacccgacctttcccgttagttccttcggtcggtaccctacgtacccggtaccccgtcgtcccgttcc

SEQ ID NO: 104027 - DNA, 685 bp, Homo sapiens
  misc_feature: GYAE6OF01CHVX6.17.34.D01.1.454.CMB.1.raw
  modified_base (261)..(261): a, c, t, g, unknown or other
  misc_feature (261)..(261): n is a, c, g, or t
tcagcgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcgggtgagggtctccgtgcaaggcttcgtggaggcaccttnagcgactatagtttcaagttgggtgcgacggcctgtggacaggccttgagtggagtgggaagatcgtcctatcgtgacacaccaactcgacacagaacgttccgaggacagacctaccaaccacgtaaacccgacggaaaccaaaacgttaaaccgaactaacgtaagttaactcgtagggacgtaccgtaagaacgtacgaccttacgtacgtagtacgtacggaacggaaccgtacgggtacctttacgttacgtttcgtacggtacgtacggtaacggtaagttaacgttactaacgtaaccgtacgttacgttaccctttaccgtttttaccctaccctttacccgttcgttaccgtttaccggtaccgggtacccgttacggtacccggtaacccccggttccgtaccccggttacccg

SEQ ID NO: 104028 - DNA, 616 bp, Homo sapiens
  misc_feature: GYAE6OF01EI3HW.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttcgtggagcaccttcagcgactatagtttcaattgggtgcgacgggcctgtggacaaggccttgagtggagtggggaaggatcgtccctagtcgttgacacaccaatacgcaacagaacgttcagggcagactcacataaccggcgaactaaattaacgaactaacagttaactcgtagagtctagaacagcctgtcagtctggagacgtacggtctttacgtacttcgtggtacgtacgtaaggtagttaacttacgtactaaactacgttacgtcctttaccttttaccaccctttacccgtttacgtccgtttaccggtaccggggtacctaacgttacccgggtaacccccgttcgtaccccgttacccg

SEQ ID NO: 104029 - DNA, 971 bp, Homo sapiens
  misc_feature: GYAE6OF01CG07N.17.34.D01.1.454.CMB.1.raw
  modified_base (142)..(142): a, c, t, g, unknown or other
  misc_feature (142)..(142): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggagttcctctttgnggtgcagcagtctacaggtcgtccagttcccaggtcccaggttcggtgacctaagttccgtggggccttaggacgggttagaacggtaccgtcccgttcggggtcccttacggggttacggtaacggggttccttccggtaggaccgtaacgggtcctttaccggtacgggtacttttacctaacccgggtttttacccttaccgttaacgttaacggttaaccgtttaccggtaaccgggttacggggtaccggacccggtaacccggtaccgggtacccggtaccggttaaccgggaaccctaaccgggtaccgttagggtacggtacggggtacgggttacggggtaaccggttacccggggtaacccttaaacccgtaacggttaccggttacggttaccgtaaccgtaacggttacgttcccgttaccgttaacccgtaacccgtaacccggtttaccccgggtaacccgggtaacttaacccggttaacccgtttaccgtaaccggttacccgtaacccgtaacccggttaccccttaccccgtaacgtaaacctaaacccggaccgttaccgtaacccgttacgtacgggttagggtacgttaccggaccgggttacgtacccgttacgacgttaccgtaccgttaccggaacccgttacggacccggtttaccgttacgtttacggttacgtacggtacggtaccgtaccggtacccgtaccggtaccgtaccggttaccggacggtaccgtaccggtaccggtcggttacggttcccgttaccgttacggtaccgttccgggtaccggaccgtcgggtcc

SEQ ID NO: 104030 - DNA, 569 bp, Homo sapiens
  misc_feature: GYAE6OF01EJZYW.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtctcctgcaaggcttctggaggcaccttcagcgactatagtttcaattgggtgcgacgggcctctggacaaggccttgagtggatggggaaggatcgtccctatcgttgacacaccaaactacgcacagaagttccagggcagactcacataaccgacggaacaaattaacgaacacagttaatctaggagctagaacagcctgtcatctgagacacgggcttctacttctgtcgtagaggtagttaattactaagtaactactcgacttaccttttaccaccttccccttgtaccttcgtcggggtacctacgtaccgggaaccccgtcgacccgttacccg

SEQ ID NO: 104031 - DNA, 777 bp, Homo sapiens
  misc_feature: GYAE6OF01AOV3F.17.34.D01.1.454.CMB.1.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatcgtgggctgaggtgaagcgctgggtcctcggtgagggtctctgnaggtcttcgnggngctacttcgagcacttatacgtttcagttgggtcgcgtacggccttcgtacggaacgaggtcctttagggaggttacggaggttagggaacggtacttacccgttccctaggttccgtacgaacctaaccgaaccaaacgttaccggacaacgagtaaacgttcccgaaggacctacgacctaccgaaccgaacgtaacccggacggtaaactaaacgtaacgactaacgtagttaagtcgtaggacgtacgtaacgtacgacgtacgtgtacgtacgttacgtacgggaacggtacgtaccgggttccttttaccgttaaccgttcggttcggaaccgggtacggttaacggttaaattaaccgtttaacgtaaacttaaccgtaccgtttcggttaacccctttttacccgttttacccgttacccgttacccggttttacgtaccccggtttaccggggtacccggtaacccttacccgggtttaaaccccgggtaacccccgtttcccggtaaccccgtttcccccg

SEQ ID NO: 104032 - DNA, 855 bp, Homo sapiens
  misc_feature: GYAE6OF01B75EN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgacaatcgtgggctgaggtgaagcgccgtggtccgtggtggagggtctcctgacgaaggtcttcgtgggacggtcctaccttcgacggacgtaaccttaagttacgttttaccgaaaggttttggggtcggtccgggtaaccggggtcccttaccggtacgggaaccgtaaacggggtcccgtttagggaggttgggaacggttagggggaaacggttacgttcccggttaccccgttagttcggtttacgaaccaacccgtaaacccaaaaccgttaccgaccgaacgtaacggtaaccgtttacccgaaggggtccaaacgtacctacccgaaccgtaaccgtaaaccccggaccggtaaacctaaaacgttaaaccgaaaccgtaacgttaacgtttaactacgtaggtaacgtacgtacgaaccgacgtaccgtacgtacctagtacgtacggaacggtaccgtaccgggttacctttaccgttacgttcgttacggtacggacggtaagggtaacgtttaaacgttactaaccgtaactacccgttacgtttccctttttacccgttttaacccttcccccgtttaccccgtttacggttacccgtttccgggtaccgggttaacccgttaccggttaccccggggtaacccccggttaccccg

SEQ ID NO: 104033 - DNA, 587 bp, Homo sapiens
  misc_feature: GYAE6OF01CD3R7.17.34.D01.1.454.CMB.1.raw
  modified_base (289)..(289): a, c, t, g, unknown or other
  misc_feature (289)..(289): n is a, c, g, or t
  modified_base (437)..(437): a, c, t, g, unknown or other
  misc_feature (437)..(437): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcaaggcttcgtggaggcaccttcagcgactattagtttcaagtttgggngcggacgggtcctcgtggacgaagggcctttggaggtggagtggggaaggacttcgtcccctatccggttagaccacaaccaaactcgacaacagaagttccgaggcagactcaaccataaccgcgaacaagtaacgaacacagtaancgtgagcagacagctgtacatcgtgagacacggtcttactactgtgtgacgaggtataacttatactaacattacgtcctttacctttaacctcccttcccttacgtaccttcgttacgggtaccctacgtacccggtaccccgttcccg

SEQ ID NO: 104034 - DNA, 563 bp, Homo sapiens
  misc_feature: GYAE6OF01E202E.17.34.D01.1.454.CMB.1.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagcgtagactagcacgaccggtgctcgatttagatcgtctgtgttgggtttggggatcacaaaacaaccagattcctcctctaaagaagccccgtgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggccaccttcagccgactatagtttcaagttgggngcggacgggcctcgtggactaagggccttgaggtggagtgggaaggntcgtcctatcggttnacacaccaaactcgacacagaagttccgaggcagcctacaccataaccgcgaacaaataacgaacacataanctganctagaacngctgtcatctgacgacgacgggtcttactacttcgtgtagcgaggagttaactactactaacactgtcctttacttttacctcccttacccttagtccttacgtcgggaccacgtccggccccgtacccg

SEQ ID NO: 104035 - DNA, 770 bp, Homo sapiens
  misc_feature: GYAE6OF01CQ8A4.17.34.D01.1.454.CMB.1.raw
  modified_base (144)..(144): a, c, t, g, unknown or other
  misc_feature (144)..(144): n is a, c, g, or t
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgnggtgcagcagctacgaggtgtccagtcccaggtccaggttggngcaatcgtggggctgaggtgaagcgctgggtcctggtgagggtctccgngacgaggcttcgnggagcaccgttnagcgtaactatagttcaagttggggtcncggacggtccttacgcgggaacgaacggtccgttaggagtgggaagtagggggaacgtacgttccggtacccttagtccggttacgaaccaacctaaccgtaaactacgaccaacgaaggaacgttcgaagggccagacctacaacgtactaaccggacggtaaacaaagttaaccgaaactacgtaagttaacgtacgtaggacgtacgtaaggtaaaccgtacgtaccttacggtacctacgttacgtaacggacggtaacccgtacggttacgtttaccgttaaccggtttcgtacgggtacggaaccggttaagggtaaactttaaacggttaacttaaaccgtaaaccgttaccgttacgttaccccgtttaacccctttttaaccgaccccgttttaccccggttagttaacccgttaccgggtacccggggtaccgttaaccggttaaccccggggtaaccccggttaaccccg

SEQ ID NO: 104036 - DNA, 676 bp, Homo sapiens
  misc_feature: GYAE6OF01BFP4C.17.34.D01.1.454.CMB.1.raw
  modified_base (294)..(294): a, c, t, g, unknown or other
  misc_feature (294)..(294): n is a, c, g, or t
  modified_base (435)..(435): a, c, t, g, unknown or other
  misc_feature (435)..(435): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggattcacgtttacctccgtatagtatcaacgtgggtgcgccgaggtccncgtggaccaacgacctgagtggatgggatcgggacaaaccctaagaccgtggtcgtcacgtgtcgttcctaccaccctatcccgtaccgggactaacgtacttaccgagtacgaaccacgtaacctcctaccaataaaccncgaacgtccctaacgtagtacggtagttaggaacggacgaccctggaacctacgttcgtacggaaccgaaccgtaccgggtccttacgttaacgttacgtcggtaggaccgaacggttaccggtaccccaacggtaccgttcccgggagacccggtaccccggtaggcccgtacggtcccggttcccgtttacggaccgtttcggtaccggggacccgaggggtccccgcccggttacggg

SEQ ID NO: 104037 - DNA, 582 bp, Homo sapiens
  misc_feature: GYAE6OF01CX9RD.17.34.D01.1.454.CMB.1.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtcctcctgcaaggcttcgtggaggcaccttnagcgtactatagtttcaagttgggngcggacggcctcgtggacaaggccttggagtggagtagggagtatcgtcctagtcgtnacacacaactcncacagagtcaggcagactcacagtacgacgaacaataacgacaactagtaatcgtaganactagaacacgctacgtacatctagacgacgacggtcttactcttcgtgtcgagtaacggattaattactaacgtactacgttacgtacctttaccttttacctaccctttcccgttacgtacgtttcgtacgggtaccctacggtacccggtaaccccgttacccg

SEQ ID NO: 104038 - DNA, 603 bp, Homo sapiens
  misc_feature: GYAE6OF01AY7DZ.17.34.D01.1.454.CMB.1.raw
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
tcagcgtagactagcacgaccggtgctcgatttagatcgtctgtgttgggtttcggggacaaaacaaccacgattccctcctctaaagaagcccctgggagcacagctcatcaccatggactggacctggaggttcctctttgtggtggctagcagctacaggtgtccagtcccaggtccagttggtgcaatctggggctgaggtgaagacgcctagggtcctggtgagggtctcctgcaaggcttctggaggcaccttcagcgactatagtttcaattggtgcgacgggcctntggacaggccttgagtggatgggaaggatcgtccctatcgttgactacaccaaactacgcacagaagttccagggcagacncaccataccgngaacaattaacgaacactagtaatctaggagctagaacacgctcgtcatactgacggacgacgggtcttcgtacttcgtcgtgacgaggtaagttaacttaacttactaaactcttacgtcctttaccctttttaccgtaccctttccccgtttggtaaccttccgtacggggtccctaacggttacccgggaaccccggttcgaaccccgttcccg

SEQ ID NO: 104039 - DNA, 682 bp, Homo sapiens
  misc_feature: GYAE6OF01CRX2M.17.34.D01.1.454.CMB.1.raw
  modified_base (343)..(343): a, c, t, g, unknown or other
  misc_feature (343)..(343): n is a, c, g, or t
tcagcgtagactagcacgaccggtgctcgatttagatcgtctgtgttgggtttggggacaaaacaaccagattcctcctctaaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtggagggtctccgtgcaaggcttctggaggcaccttcagcgactatagtttcaattgggtgcggacggcctcgtggacaaggccttggagtggactgggaagactcggtcctagtcgtttanaccgaacctaacctaaactacgactaacgaacgtaaggttaccgaggtcaagtacctacaacccgataaacccggacggaaactaaaaagttaaccgaaactaaccaaggtttaaacaccgtaggaacgtctaagaactacgccttagtactacgtacgtcggacggtaacgacgggtacctttacgtaacctttcgtagtacggtaggaacggtaagttaactttacgtaaactaaccgtaactccgttcgtttaacccttttaccctaccctttaccttacgttacccgttcggtccggtacctacggtcccggtaaacccggtctcccggttaccc

SEQ ID NO: 104040 - DNA, 883 bp, Homo sapiens
  misc_feature: GYAE6OF01EP88C.17.34.D01.1.454.CMB.1.raw
  modified_base (164)..(164): a, c, t, g, unknown or other
  misc_feature (164)..(164): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttccttctttggtggtggcagcagctacgnggtgtccacgtcccgaggtccgtagttggtcgcaagtcgtgggctggaggtgaagcgccgtgggtcctcggtgtcggtctccgtgaccgtaaggcttcgtggacggcctaccgttcacggaccgtaacttagttacgtttactaaggttgggtcggacggtacgggtccctacggtggacgtaacggtccgttggacggtaggaggtacggggaacgtacgttccgttacccgtagttccgttacgaaccgaacctaaacccgtaaacgtaccgacgaacgtaaggtaaccgttaccgagggacaacgacctacgaaccacgtaaccgacgaaacctaaacgttaacgaaaccaagttacgttaaatccggtaagacggtacagaaaccgtcgtacctgtactactacggtagggaaccgtacggtaccggttacctttaccgttaccgttttaccgggtagtttacccggggaaacggttaacgggtttaactttaaaaccgtttaacccggttaaacgttaaaccccgttaccgttttacccgggttttaaccccttttttaacccccccgggtttttaaccccttaaaccccccggttttaccccgtttttaacggttaccccccgttttttaaacggggtaccccccggggtaaaccccttttaacccgggggtttaaaccccccggggaaaccccccggttttaaccccccggg

SEQ ID NO: 104041 - DNA, 746 bp, Homo sapiens
  misc_feature: GYAE6OF01DB943.17.34.D01.1.454.CMB.1.raw
  modified_base (309)..(309): a, c, t, g, unknown or other
  misc_feature (309)..(309): n is a, c, g, or t
tcagcgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcgggtgagggtctccgtgcaagggtcttcgtggacggtccaccttgagcgtaactagttagtttcaagttgggtgcggacgggcctcgnggacaggtccttgagtggagtgggaagtctcgtcctatcgttgaacaccaacctaaacgtccgcacgaagtaacgtccgagggcagacctcaacacgtaaaccgcgaaactaaagtaacgacaacgtagttaaatcgtaggactacgtagaaccgtacgtcccttagtacctaagttccggtaaggaaccggaacccggtacgggttccttttacgtaactttccgaggttacgggacggtaagggtaaactttaactttaaccgttaacgtaaaccctacgttccggtaacccttttttaccccgttttaaaaccccgtccccgtttttaccccgttaacgggttaccccgttttacccgggtaccgggggtaaccccttaacgggtaacccccgggggttaaacccccccgttcccgtaaccccggtttaccccg

SEQ ID NO: 104042 - DNA, 591 bp, Homo sapiens
  misc_feature: GYAE6OF01D62DD.17.34.D01.1.454.CMB.1.raw
  modified_base (256)..(256): a, c, t, g, unknown or other
  misc_feature (256)..(256): n is a, c, g, or t
  modified_base (324)..(324): a, c, t, g, unknown or other
  misc_feature (324)..(324): n is a, c, g, or t
tcagcgtagactagcacgaccggtgctcgatttagatcgtctgtgttgggtttggggacaaaacaaccagattcctcctctaaagaagccccgtgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttctggaggcaccttnagcgactatagtttcaagttgggtgcgacgggcctactggacaaggtccttgacgtggatgggaaggntcgtcctatcgttgacacaccaactcgcacagaagttccaggcagacctcgaccataaccgcggaacaaattacgaacacagttaatcgtagagctagaacacgcctagtcatctagacggacgacgggtacttctacgttctcgtcggacgtaggtagttaacgttactaactaactacttcgtacctttaccttttacctacccttcccttacgtaccttcgtacgggtcctacgtccggtaaccccggtcctacccggttcccg

SEQ ID NO: 104043 - DNA, 574 bp, Homo sapiens
  misc_feature: GYAE6OF01BS4VB.17.34.D01.1.454.CMB.1.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (565)..(565): a, c, t, g, unknown or other
  misc_feature (565)..(565): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggngcgacgggcctntggacaaggccttgagtggatgggagntcgtcctatcgttgacacaccaaactcgcacagaacgtccaggcagactcaccataaccgcggaacaaacttaacgaacacagttaactcgtaggagctagaacacgcctgtacatcgtgacggacacgggtcttacgtacttctagtcgacgagtacgttaattactataactacttcgtaccttaccttttaccacccttcccttcgtaccttcgtcgggtacctacgtaccggtaaccccgtcncccgttccc

SEQ ID NO: 104044 - DNA, 600 bp, Homo sapiens
  misc_feature: GYAE6OF01AWD53.17.34.D01.1.454.CMB.1.raw
  modified_base (327)..(327): a, c, t, g, unknown or other
  misc_feature (327)..(327): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagcgtagactagcacgaccggtgctcgatttagatcgtctgtgttgggtttgggatcacaaaacaaccagacttcctcctctaaagaagcccctgggagcacagctcatcaccatggactggacctggaggttcctctttgtggtggcagcagctacgaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaaggccttgagtggagtgggaaggntcgtcctagtcgttgacacaccaactacgcacgagaaacgttcaagggcagactcacactaacgcgaacaaataacgacaacatatactggacgctagaacngtacctgtacatacnggacgacgtacggtcttacttaccttnttaggngtaccgtaggtaagttaactttacctaattaaaccgacgttacgtccgtttaccttttaacccgtcccttcccgtttctacgttcgtacgggtacctacggttccggtaaccccggttacccg

SEQ ID NO: 104045 - DNA, 554 bp, Homo sapiens
  misc_feature: GYAE6OF01AVORK.17.34.D01.1.454.CMB.1.raw
  modified_base (386)..(386): a, c, t, g, unknown or other
  misc_feature (386)..(386): n is a, c, g, or t
  modified_base (503)..(503): a, c, t, g, unknown or other
  misc_feature (503)..(503): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaagatcgtccctagtcgttgacacaccaaactcgcacagaagttccaggcagactcaccataaccgnggacaattaacgaacacagttaatcgtaggagactagaacacgcctgtcatctgacggacacggtcttactacttcgtgtgcgaggataatactatacactcgtcttaccttttacncccttcccttcgtaccttccgtcgggtacctacgtccggtacccgtacccg

SEQ ID NO: 104046 - DNA, 679 bp, Homo sapiens
  misc_feature: GYAE6OF01BN725.17.34.D01.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
tcagcgtagactagcacgaccggtgctcgatttagatcgtctgtgttgggtttggggatcacaaaacaaccacgattcctcctctaaagaagccccgtgggagcacagctcatcaccatggactggacctggaggttcctctttgtgggtggcagcagctacgaggtgtccagtcccaggtccagttggtgcaatctggggctgaggtgaagacgcctgggtcctcggtgagggtctcctgcgaaggcttcgngggaggcaccttcacgcgactattagtttcaagttgggtgcggacgggcctcgtggacaaggccgttggagtggagtagggaagntcgtcctagtcgttanacacacctaacacgcacagtaactccgagggacacgactcaacctaacgtaaccggacggtaactaaactaaaccgaacaactaacgttaattcgtaggacgtacgtacgaacgacgtcctacgtactactcgtaggaacggtaccggtaccgggttccttactttaccgttctaggttcgacggtaggtaacgttaagttaactaactaaacctacgttacgttaccttttacccgtttttaccctaccctttaccccgtttacgttaccgtttcgggtccgggtaacccttccggttacccgggtaacccccggttaccccgg

SEQ ID NO: 104047 - DNA, 596 bp, Homo sapiens
  misc_feature: GYAE6OF01CDDJL.17.34.D01.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (555)..(555): a, c, t, g, unknown or other
  misc_feature (555)..(555): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaagtctggggctgaggtgaagcgctgggtcctggtgaggtctcctgcaggcttgnggagcacttnagcgactatagtttcaagttgggtgcgacgggcctcgtggacaaggtccttggagtggagtgggaagatccgtcctagtccgttgacacaaccaaactcgacacagtaacgttccgagggcagactcaaccataacccgaggaacaaattaacgaacaacgtaagttaatcgtaggacgtactagaacacgtcctagtacatcgtagacgacgacggtcttacgtacgttcgtgtgacggagtagttaacttaacgtaataactacgtcgtaccgtttaccttttaccaccctttacccttntacgttcgtacgggacctaacgtccggtaccccgttacccg

SEQ ID NO: 104048 - DNA, 648 bp, Homo sapiens
  misc_feature: GYAE6OF01A0XUF.17.34.D01.1.454.CMB.1.raw
tcagcgtagactagcacgaccggtgctcgatttagatcgtctgtgttgggtttggggatcacaaaacaaccagattcctcctctaaagaagccccctgggagcacagctcatcaccatggactggaccctggagttcctcttgtggtggcagcagctacaggtgtccagtcccaggtccagttggtgcaatctggggctgaggtgaagacgccgtgggtcctcggtgagggtctccctgcgaaggtccttcgtgggaggccaccttcgagccgactatagtttcaagttgggtgcgacggcctctggacaaggccttgagtggagtgggaaggtatccgtccctagtcgttgaccaacgaaccaaactacgacaacagtaacgttccgagggacacgacctacaccaacgtaaccggacgaacaaacttaaccgacaacgtaagttaactacgtaggacacgtagaaccagtccgtagtctatcgtagacggtaccgacgggtccttacttaccttcgtcgtacggacgaaggtacttaaacgttactaagtaccacgttacgttaccctttaccgttttaccctcccttacccgttgttaccttccggtcgggtacctacggtacccgggtaacccccgttacccgg

SEQ ID NO: 104049 - DNA, 826 bp, Homo sapiens
  misc_feature: GYAE6OF01A5B6M.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggtcttcgtggacggcaccttcgagcgaactagtacgtttcaagttgggtgtaccggacggggtccctacgtggaacaacggtcccgtttggagggttggaaggtagggggtaaacgggtacgttacccggttacccgttaacgtttccgtttacgggaaccctaacccgtaaaacccctaaaaccgttaccgacctaaaccgaaacggtaaacggtttacccggaacggggaccaaccgggtaacctacccgaaacccgtaaacgttaaaaccccgggaccggtaaaactaaaaaccggttaaaccgtaaaccaacgtaaacgtttaaacgtaccgttagggaactaccgtacggaaacctcggtacccctaggtacctaaccgtcgtaacggtaaggtacccgtacgggttccctttaccttacgtttctcgggtagaccggtaaggttaacttaagttaaccgttaagtaactaccgttagtacccttttacctttaccctacccgttcccctttcgttaccgtttaccggccgggttaacctacgggttaccccggtaccccgggttcctaaccccgttcccg

SEQ ID NO: 104050 - DNA, 884 bp, Homo sapiens
  misc_feature: GYAE6OF01ACYBW.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccgaggtccagttggtgcaatcgtggggctggaggtagaagacgccgtgggtccgtcgggtgagggtctcctgacaaggtcttcgtgggacggcctaccgttcgaacgccgaacttaagtacgttttacaaggttgggtacggtaccggaccgggtcctacgtacgggaacgtaaacgggtcccgtttaggtacggtagggaacggtaggggtaacggtacgttacccggttacccgttaacgttacgggttacgaaacccgaaaccgtaaaccccgtaaaaaccgtacccgtaacgaaacgtaaacggtaaaccggtttacccggaacgggtaaccgaaccgtaaccgtacaaacccggtaaacgtaaaaccccgggaaccggtaaaactaaaaacgttaaaccggaaactaaccgtaaacgtttaaacgtacgtaacggtacggtaacgtaacggaaaccgtacgttaccgtcggttaacctacgtacgtacggaacggaaccgtaaccggtaccgttacgttacttcgtaggtacggtacggaacggttaagttaactaaccgttaaacgttaacctacgttaccgtttaaccgtttacccgtttttaccctaaccccgttaccgtttaacggtacccgttttacgggtacccgggttaaacccgtacggttaaccccgggtaaccccggttcccggtaccccgtttaccccg

SEQ ID NO: 104051 - DNA, 558 bp, Homo sapiens
  misc_feature: GYAE6OF01B1T1X.17.34.D01.1.454.CMB.1.raw
  modified_base (326)..(326): a, c, t, g, unknown or other
  misc_feature (326)..(326): n is a, c, g, or t
  modified_base (424)..(424): a, c, t, g, unknown or other
  misc_feature (424)..(424): n is a, c, g, or t
  modified_base (507)..(507): a, c, t, g, unknown or other
  misc_feature (507)..(507): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggagtgggaagtntcgtcctatcgttagacacaccaactacgcacagaacgttcaggacagactcacagtaccgcgacaatacgaacacagtaatcgtagagctagaacgngcctgtcatcgtagagacgacggtcttactacttcgtgtacgcgtaggtagtaattactatacactcgtcttaccttttaccnccttacccgttgtaccgttcgtcgggtacctacgtcggtacccccgtaccg

SEQ ID NO: 104052 - DNA, 659 bp, Homo sapiens
  misc_feature: GYAE6OF01EZ64Z.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcaatcgtggggctgaggtgaagcgccgtgggtcctgggtgagggtctcgtgcaggtcttgtggagccacttcagcgactatagttcaagttgggtgcggacggcctgtaggacaaggccttggaggtggaggtgggaagactcgtcctgtcgtgaccacaaccaactcgacacgagtaacgtcgagggtacagtacctaccaccgtaactaaccggacggtaactaaaacgttaacgaaactaaccgtaagttaactcgtacggaacgactaacgaacgacgtccgttagtctactacgtaggtacggacggtacggtccttacgttacctcgttgtacggtacgtaaggtaacgttaacttaactaacgtaaacctacgttccgttacctttacccttttaccctacccgtttccttacgttaccgttcggtacgggtacccttacggtacccgggtacccccggtaccg

SEQ ID NO: 104053 - DNA, 890 bp, Homo sapiens
  misc_feature: GYAE6OF01CWNK5.17.34.D01.1.454.CMB.1.raw
tcagcgtagactagcacgaccggtgctcgatttagatcgtctgtgttgggtttggggatcacaaaacaaccagattcctcctctaaagaagccccgtgggagcacagctcatcaccatggactggacctggagttcctctttgtggtggcagcagctacaggtgtccagtcccaggtccaggttggtgcaatcgtggggctgaggtgaagccgccgtgggtcctcgggtgcgggtcctcctgcgaaggtcttcgtgggacggctacccttgacgcgtaacttagttacggttttacgaagtttcggggtacggccggtaaccggggtccttcggtacgggaaccgtaaacgggtccgtttaagggacggttaggggtaaggtacgggggaaagtacggtttccccgttaccccgtttaggtacccggtttacgaaccaaccgtaaaccctaaacgtaccgaccgaaaccgaaggtaaaccgttccggaacgggtacctaacggacccgttaccaaacccgtaacggtaaaccccgggaaccggtaaacctaaaacgttaaaccgaaacccgtaaacgttaacgttaaacgttccgtacgggtaacgtacgttaacggaaacctaacgggtaccttacggtacctacgttaccgtacgggaaccggtaccgggttacgggttaccttttaccggtttaccgtttacgttcgggttacggaacgggttaaggtaacgtttaaactttaaacctaaccgttaaactaccgttaccgtttaccccttttaccccgtttttaacccttaccccgttttacccgtttaccgttacccgtttaccgggtacccgggttaccgtaaccggttacccggggtaacccccgttaccccgg

SEQ ID NO: 104054 - DNA, 660 bp, Homo sapiens
  misc_feature: GYAE6OF01B6HF0.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctggtgagggtctcctgcaaggcttcgtggagcaccttcagcgactattagtttcaagttgggtgcgacgggtcctcgtggacaaggccttggagtggagtggaggntcgtcctatcgtgacacacaactacgcacagtacgtcgaggcacgactacacactaaccgacgaactaaataaccgaacacgtaagttaactcgtaggagtactagaacacggtacctcgtactatcgtaggaaggaccgtaccgggtctttacgtaacgtttcgtaggtcggtacggtaaggttaacgttaactttacgtaactaaccgtacttacggttacccttttacccttttaacccgtacccgtttacccctttacggttacctttcccggttcgggtaacccttacgtaaccccggggtacccccggttccgtaaccccggtttccccg
